United States Patent
Fodor et al.

(10) Patent No.: US 11,993,814 B2
(45) Date of Patent: *May 28, 2024

(54) DIGITAL COUNTING OF INDIVIDUAL MOLECULES BY STOCHASTIC ATTACHMENT OF DIVERSE LABELS

(71) Applicant: Becton, Dickinson and Company, Franklin Lakes, NJ (US)

(72) Inventors: Stephen P. A. Fodor, San Jose, CA (US); Glenn K. Fu, San Jose, CA (US)

(73) Assignee: Becton, Dickinson and Company, Franklin Lakes, NJ (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/190,884

(22) Filed: Mar. 27, 2023

(65) Prior Publication Data

US 2023/0366022 A1 Nov. 16, 2023

Related U.S. Application Data

(63) Continuation of application No. 16/846,133, filed on Apr. 10, 2020, which is a continuation of application No. 15/217,886, filed on Jul. 22, 2016, now Pat. No. 10,619,203, which is a continuation of application No. 14/281,706, filed on May 19, 2014, now Pat. No. 9,816,137, which is a continuation of application No. 12/969,581, filed on Dec. 15, 2010, now Pat. No. 8,835,358.

(60) Provisional application No. 61/286,768, filed on Dec. 15, 2009.

(51) Int. Cl.
| | |
|---|---|
| *C12Q 1/6874* | (2018.01) |
| *C12N 15/10* | (2006.01) |
| *C12Q 1/6809* | (2018.01) |
| *C12Q 1/6837* | (2018.01) |
| *C12Q 1/6851* | (2018.01) |
| *C12Q 1/686* | (2018.01) |
| *C12Q 1/6869* | (2018.01) |
| *C12Q 1/6876* | (2018.01) |
| *G16B 25/00* | (2019.01) |
| *G16B 25/20* | (2019.01) |
| *G16B 30/00* | (2019.01) |
| *G16B 25/10* | (2019.01) |

(52) U.S. Cl.
CPC ....... *C12Q 1/6874* (2013.01); *C12N 15/1065* (2013.01); *C12Q 1/6809* (2013.01); *C12Q 1/6837* (2013.01); *C12Q 1/6851* (2013.01); *C12Q 1/686* (2013.01); *C12Q 1/6869* (2013.01); *C12Q 1/6876* (2013.01); *G16B 25/00* (2019.02); *G16B 25/20* (2019.02); *G16B 30/00* (2019.02); *G16B 25/10* (2019.02)

(58) Field of Classification Search
None
See application file for complete search history.

(56) References Cited

U.S. PATENT DOCUMENTS

| | | |
|---|---|---|
| 4,510,244 A | 4/1985 | Parks et al. |
| 4,725,536 A | 2/1988 | Fritsch et al. |
| 5,124,246 A | 6/1992 | Urdea et al. |
| 5,137,809 A | 8/1992 | Loken et al. |
| 5,149,625 A | 9/1992 | Church et al. |
| 5,200,314 A | 4/1993 | Urdea |
| 5,308,990 A | 5/1994 | Takahashi et al. |
| 5,424,186 A | 6/1995 | Fodor et al. |
| 5,424,413 A | 6/1995 | Hogan et al. |
| 5,445,934 A | 8/1995 | Fodor et al. |
| 5,470,570 A | 11/1995 | Taylor et al. |
| 5,604,097 A | 2/1997 | Brenner |
| 5,635,352 A | 6/1997 | Urdea et al. |
| 5,635,400 A | 6/1997 | Brenner |
| 5,648,245 A | 7/1997 | Fire et al. |
| 5,654,413 A | 8/1997 | Brenner |

(Continued)

FOREIGN PATENT DOCUMENTS

| | | |
|---|---|---|
| CA | 2474509 | 2/2003 |
| CA | 2961210 A1 | 3/2016 |

(Continued)

OTHER PUBLICATIONS

Hug et al. Measurement of the number of molecules of a single mRNA species in a complex mRNA preparation. 2003. Journal of Theoretical Biology. vol. 221, No. 4, pp. 615-623. (Year: 2003).*
10X Genomics, Inc., 2019, User Guide: Visium Spatial Gene Expression Reagent Kits, www.10xGenomics.com, 76 pp.
2018 Top 10 Innovations, The Scientist Magazine® (2018). Available at: https://www.thescientist.com/features/2018-top-10-innovations-65140, 16 pp.
10X Genomics, Inc., 2022, "Chromium Fixed RNA Profiling Reagent Kits," 10xGenomics.com, User Guide, in 95 pages.

(Continued)

*Primary Examiner* — Channing S Mahatan
(74) *Attorney, Agent, or Firm* — Sheppard, Mullin, Richter & Hampton LLP

(57) ABSTRACT

Compositions, methods and kits are disclosed for high-sensitivity single molecule digital counting by the stochastic labeling of a collection of identical molecules by attachment of a diverse set of labels. Each copy of a molecule randomly chooses from a non-depleting reservoir of diverse labels. Detection may be by a variety of methods including hybridization based or sequencing. Molecules that would otherwise be identical in information content can be labeled to create a separately detectable product that is unique or approximately unique in a collection. This stochastic transformation relaxes the problem of counting molecules from one of locating and identifying identical molecules to a series of binary digital questions detecting whether preprogrammed labels are present. The methods may be used, for example, to estimate the number of separate molecules of a given type or types within a sample.

30 Claims, 30 Drawing Sheets

Specification includes a Sequence Listing.

(56) References Cited

U.S. PATENT DOCUMENTS

| | | |
|---|---|---|
| 5,656,731 A | 8/1997 | Urdea |
| 5,658,737 A | 8/1997 | Nelson et al. |
| 5,714,330 A | 2/1998 | Brenner et al. |
| 5,744,305 A | 4/1998 | Fodor et al. |
| 5,759,778 A | 6/1998 | Li et al. |
| 5,763,175 A | 6/1998 | Brenner |
| 5,800,992 A | 9/1998 | Fodor et al. |
| 5,830,712 A | 11/1998 | Rampersad et al. |
| 5,846,719 A | 12/1998 | Brenner et al. |
| 5,854,033 A | 12/1998 | Lizardi |
| 5,871,928 A | 2/1999 | Fodor et al. |
| 5,925,525 A | 7/1999 | Fodor et al. |
| 5,935,793 A | 8/1999 | Wong |
| 5,962,271 A | 10/1999 | Chenchik et al. |
| 5,962,272 A | 10/1999 | Chenchik et al. |
| 5,968,740 A | 10/1999 | Fodor et al. |
| 5,981,176 A | 11/1999 | Wallace |
| 5,981,179 A | 11/1999 | Lorinez et al. |
| 6,013,445 A | 1/2000 | Albrecht et al. |
| 6,040,138 A | 3/2000 | Lockhart et al. |
| 6,046,005 A | 4/2000 | Ju et al. |
| 6,060,596 A | 5/2000 | Lerner et al. |
| 6,064,755 A | 5/2000 | Some |
| 6,114,149 A | 9/2000 | Fry et al. |
| 6,117,631 A | 9/2000 | Nilsen |
| 6,124,092 A | 9/2000 | O'neill et al. |
| 6,138,077 A | 10/2000 | Brenner |
| 6,140,489 A | 10/2000 | Brenner |
| 6,172,214 B1 | 1/2001 | Brenner |
| 6,197,506 B1 | 3/2001 | Fodor et al. |
| 6,197,554 B1 | 3/2001 | Lin et al. |
| 6,214,558 B1 | 4/2001 | Shuber et al. |
| 6,235,475 B1 | 5/2001 | Brenner et al. |
| 6,235,483 B1 | 5/2001 | Wolber et al. |
| 6,265,163 B1 | 7/2001 | Albrecht et al. |
| 6,268,152 B1 | 7/2001 | Fodor et al. |
| 6,284,460 B1 | 9/2001 | Fodor et al. |
| 6,284,485 B1 | 9/2001 | Boyle et al. |
| 6,309,822 B1 | 10/2001 | Fodor et al. |
| 6,309,823 B1 | 10/2001 | Cronin et al. |
| 6,326,148 B1 | 12/2001 | Pauletti et al. |
| 6,355,431 B1 | 3/2002 | Chee et al. |
| 6,355,432 B1 | 3/2002 | Fodor et al. |
| 6,372,813 B1 | 4/2002 | Johnson et al. |
| 6,395,491 B1 | 5/2002 | Fodor et al. |
| 6,406,848 B1 | 6/2002 | Bridgham et al. |
| 6,436,675 B1 | 8/2002 | Welch et al. |
| 6,440,667 B1 | 8/2002 | Fodor et al. |
| 6,440,706 B1 | 8/2002 | Vogelstein et al. |
| 6,451,536 B1 | 9/2002 | Fodor et al. |
| 6,458,530 B1 | 10/2002 | Morris et al. |
| 6,468,744 B1 | 10/2002 | Cronin et al. |
| 6,480,791 B1 | 11/2002 | Strathmann |
| 6,489,114 B2 | 12/2002 | Laayoun et al. |
| 6,489,116 B2 | 12/2002 | Wagner |
| 6,492,121 B2 | 12/2002 | Kurane et al. |
| 6,500,620 B2 | 12/2002 | Yu et al. |
| 6,512,105 B1 | 1/2003 | Hogan et al. |
| 6,514,699 B1 | 2/2003 | O'neill et al. |
| 6,544,739 B1 | 4/2003 | Fodor et al. |
| 6,551,784 B2 | 4/2003 | Fodor et al. |
| 6,576,424 B2 | 6/2003 | Fodor et al. |
| 6,600,996 B2 | 7/2003 | Webster et al. |
| 6,629,040 B1 | 9/2003 | Goodlett et al. |
| 6,653,077 B1 | 11/2003 | Brenner |
| 6,753,147 B2 | 6/2004 | Vogelstein et al. |
| 6,787,308 B2 | 9/2004 | Balasubramanian et al. |
| 6,808,906 B2 | 10/2004 | Shen et al. |
| 6,849,404 B2 | 2/2005 | Park et al. |
| 6,852,488 B2 | 2/2005 | Fodor et al. |
| 6,858,412 B2 | 2/2005 | Willis et al. |
| 6,890,741 B2 | 5/2005 | Fan et al. |
| 6,946,251 B2 | 9/2005 | Kurn |
| 6,974,669 B2 | 12/2005 | Mirkin et al. |
| 7,022,479 B2 | 4/2006 | Wagner |
| 7,034,145 B2 | 4/2006 | Shen et al. |
| 7,155,050 B1 | 12/2006 | Sloge |
| 7,294,466 B2 | 11/2007 | McMillan |
| 7,323,309 B2 | 1/2008 | Mirkin et al. |
| 7,393,665 B2 | 7/2008 | Brenner |
| 7,407,757 B2 | 8/2008 | Brenner |
| 7,424,368 B2 | 9/2008 | Huang et al. |
| 7,432,055 B2 | 10/2008 | Pemov et al. |
| 7,470,515 B2 | 12/2008 | Rashtchian et al. |
| 7,473,767 B2 | 1/2009 | Dimitrov |
| 7,476,786 B2 | 1/2009 | Chan et al. |
| 7,537,897 B2 | 5/2009 | Brenner et al. |
| 7,544,473 B2 | 6/2009 | Brenner |
| 7,635,566 B2 | 12/2009 | Brenner |
| 7,638,612 B2 | 12/2009 | Rashtchian et al. |
| 7,718,403 B2 | 5/2010 | Kamberov et al. |
| 7,771,946 B2 | 8/2010 | Kurn |
| 7,822,555 B2 | 10/2010 | Huang et al. |
| 7,824,856 B2 | 11/2010 | Monforte |
| 7,824,889 B2 | 11/2010 | Vogelstein et al. |
| 7,915,015 B2 | 3/2011 | Vogelstein et al. |
| 7,985,546 B2 | 7/2011 | Church et al. |
| 8,071,311 B2 | 12/2011 | Kurn |
| 8,110,351 B2 | 2/2012 | Bosnes |
| 8,114,681 B2 | 2/2012 | Martin et al. |
| 8,148,068 B2 | 4/2012 | Brenner |
| 8,168,385 B2 | 5/2012 | Brenner |
| 8,206,913 B1 | 6/2012 | Kamberov et al. |
| 8,241,850 B2 | 8/2012 | Brenner |
| 8,298,767 B2 | 10/2012 | Brenner et al. |
| 8,318,433 B2 | 11/2012 | Brenner |
| 8,367,051 B2 | 2/2013 | Matyjaszewski et al. |
| 8,420,324 B2 | 4/2013 | Rashtchian et al. |
| 8,445,205 B2 | 5/2013 | Brenner |
| 8,470,996 B2 | 6/2013 | Brenner |
| 8,476,018 B2 | 7/2013 | Brenner |
| 8,481,292 B2 | 7/2013 | Casbon et al. |
| 8,535,889 B2 | 9/2013 | Larson et al. |
| 8,563,274 B2 | 10/2013 | Brenner et al. |
| 8,603,749 B2 | 12/2013 | Gillevet et al. |
| 8,679,756 B1 | 3/2014 | Brenner et al. |
| 8,685,678 B2 | 4/2014 | Casbon et al. |
| 8,685,753 B2 | 4/2014 | Martin et al. |
| 8,715,967 B2 | 5/2014 | Casbon et al. |
| 8,722,368 B2 | 5/2014 | Casbon et al. |
| 8,728,766 B2 | 5/2014 | Casbon et al. |
| 8,741,606 B2 | 6/2014 | Casbon et al. |
| 8,835,110 B2 | 9/2014 | Wang et al. |
| 8,835,358 B2 | 9/2014 | Fodor et al. |
| 8,841,071 B2 | 9/2014 | Link |
| 8,856,410 B2 | 10/2014 | Park |
| 8,865,470 B2 | 10/2014 | Yan et al. |
| 9,150,852 B2 | 10/2015 | Samuels et al. |
| 9,181,582 B2 | 11/2015 | Kurn |
| 9,188,586 B2 | 11/2015 | Fan et al. |
| 9,228,229 B2 | 1/2016 | Olson et al. |
| 9,262,376 B2 | 2/2016 | Tsuto |
| 9,290,808 B2 | 3/2016 | Fodor et al. |
| 9,290,809 B2 | 3/2016 | Fodor et al. |
| 9,297,047 B2 | 3/2016 | Furchak et al. |
| 9,315,857 B2 | 4/2016 | Fu et al. |
| 9,371,598 B2 | 6/2016 | Chee |
| 9,567,645 B2 | 2/2017 | Fan et al. |
| 9,567,646 B2 | 2/2017 | Fan et al. |
| 9,582,877 B2 | 2/2017 | Fu et al. |
| 9,593,365 B2 | 3/2017 | Frisen et al. |
| 9,598,736 B2 | 3/2017 | Fan et al. |
| 9,637,799 B2 | 5/2017 | Fan et al. |
| 9,644,204 B2 | 5/2017 | Hindson et al. |
| 9,677,131 B2 | 6/2017 | Fredriksson et al. |
| 9,689,024 B2 | 6/2017 | Hindson et al. |
| 9,695,468 B2 | 7/2017 | Hindson et al. |
| 9,708,659 B2 | 7/2017 | Fodor et al. |
| 9,727,810 B2 | 8/2017 | Fodor et al. |
| 9,787,810 B1 | 10/2017 | Chiang |
| 9,816,137 B2 | 11/2017 | Fodor et al. |
| 9,845,502 B2 | 12/2017 | Fodor et al. |
| 9,850,515 B2 | 12/2017 | McCoy et al. |
| 9,856,530 B2 | 1/2018 | Hindson et al. |

(56) References Cited

U.S. PATENT DOCUMENTS

| | | | |
|---|---|---|---|
| 9,868,979 B2 | 1/2018 | Chee et al. | |
| 9,879,313 B2 | 1/2018 | Chee et al. | |
| 9,905,005 B2 | 2/2018 | Fu et al. | |
| 9,938,523 B2 | 4/2018 | LaBaer | |
| 9,951,386 B2 | 4/2018 | Hindson et al. | |
| 9,988,660 B2 | 6/2018 | Rashtchian et al. | |
| 10,002,316 B2 | 6/2018 | Fodor et al. | |
| 10,011,872 B1 | 7/2018 | Belgrader et al. | |
| 10,017,761 B2 | 7/2018 | Weissman et al. | |
| 10,023,910 B2 | 7/2018 | Drmanac et al. | |
| 10,030,267 B2 | 7/2018 | Hindson et al. | |
| 10,041,116 B2 | 8/2018 | Hindson et al. | |
| 10,047,394 B2* | 8/2018 | Fodor | G16B 25/20 |
| 10,059,991 B2* | 8/2018 | Fodor | C12Q 1/6869 |
| 10,131,958 B1 | 11/2018 | Fan et al. | |
| 10,138,518 B2 | 11/2018 | Chun | |
| 10,151,003 B2 | 12/2018 | Fan et al. | |
| 10,202,641 B2 | 2/2019 | Shum | |
| 10,202,646 B2* | 2/2019 | Fodor | C12Q 1/6809 |
| 10,208,343 B2 | 2/2019 | Hindson et al. | |
| 10,208,356 B1 | 2/2019 | Fan et al. | |
| 10,227,648 B2 | 3/2019 | Hindson et al. | |
| 10,246,703 B2 | 4/2019 | Church et al. | |
| 10,253,364 B2 | 4/2019 | Hindson et al. | |
| 10,253,375 B1 | 4/2019 | Fan et al. | |
| 10,266,874 B2 | 4/2019 | Weissleder et al. | |
| 10,273,541 B2 | 4/2019 | Hindson et al. | |
| 10,288,608 B2 | 5/2019 | Kozlov et al. | |
| 10,294,511 B2 | 5/2019 | Sanches-Kuiper et al. | |
| 10,301,677 B2 | 5/2019 | Shum et al. | |
| 10,308,982 B2 | 6/2019 | Chee | |
| 10,323,278 B2 | 6/2019 | Belgrader et al. | |
| 10,337,061 B2 | 7/2019 | Hindson et al. | |
| 10,338,066 B2 | 7/2019 | Fan et al. | |
| 10,344,329 B2 | 7/2019 | Hindson et al. | |
| 10,392,661 B2* | 8/2019 | Fodor | C12N 15/1065 |
| 10,450,607 B2 | 10/2019 | Hindson et al. | |
| 10,550,429 B2 | 2/2020 | Harada et al. | |
| 10,619,186 B2 | 4/2020 | Betts et al. | |
| 10,619,203 B2* | 4/2020 | Fodor | G16B 30/00 |
| RE47,983 E | 5/2020 | Gao et al. | |
| 11,092,607 B2 | 8/2021 | Gaublomme et al. | |
| 11,460,468 B2 | 10/2022 | Fan et al. | |
| 11,467,157 B2 | 10/2022 | Fan et al. | |
| 11,535,882 B2 | 12/2022 | Fu et al. | |
| 2001/0024784 A1 | 9/2001 | Wagner | |
| 2001/0036632 A1 | 11/2001 | Yu et al. | |
| 2002/0019005 A1 | 2/2002 | Kamb | |
| 2002/0051986 A1 | 5/2002 | Baez et al. | |
| 2002/0065609 A1 | 5/2002 | Ashby | |
| 2002/0072058 A1 | 6/2002 | Voelker et al. | |
| 2002/0094116 A1 | 7/2002 | Forst et al. | |
| 2002/0132241 A1 | 9/2002 | Fan et al. | |
| 2002/0168665 A1 | 11/2002 | Okawa | |
| 2002/0172953 A1 | 11/2002 | Mirkin et al. | |
| 2002/0187480 A1 | 12/2002 | Brandon | |
| 2002/0192687 A1 | 12/2002 | Mirkin et al. | |
| 2003/0003490 A1 | 1/2003 | Fan et al. | |
| 2003/0013091 A1 | 1/2003 | Dimitrov | |
| 2003/0032049 A1 | 2/2003 | Wagner | |
| 2003/0049616 A1 | 3/2003 | Brenner et al. | |
| 2003/0077611 A1 | 4/2003 | Slepnev | |
| 2003/0082818 A1 | 5/2003 | Bahnson et al. | |
| 2003/0087242 A1 | 5/2003 | Mirkin et al. | |
| 2003/0104436 A1 | 6/2003 | Morris et al. | |
| 2003/0165935 A1 | 9/2003 | Vann et al. | |
| 2003/0175908 A1 | 9/2003 | Linnarsson | |
| 2003/0186251 A1 | 10/2003 | Dunn et al. | |
| 2003/0207296 A1 | 11/2003 | Park et al. | |
| 2003/0207300 A1 | 11/2003 | Matray et al. | |
| 2004/0047769 A1 | 3/2004 | Tanaami | |
| 2004/0091864 A1 | 5/2004 | French et al. | |
| 2004/0096368 A1 | 5/2004 | Davis et al. | |
| 2004/0096892 A1 | 5/2004 | Wang et al. | |
| 2004/0121342 A1 | 6/2004 | McKeown | |
| 2004/0146901 A1 | 7/2004 | Morris et al. | |
| 2004/0147435 A1 | 7/2004 | Hawiger et al. | |
| 2004/0157243 A1 | 8/2004 | Huang et al. | |
| 2004/0209298 A1 | 10/2004 | Kamberov et al. | |
| 2004/0224325 A1 | 11/2004 | Knapp et al. | |
| 2004/0259118 A1 | 12/2004 | Macevicz | |
| 2005/0019776 A1 | 1/2005 | Callow et al. | |
| 2005/0032110 A1 | 2/2005 | Shen et al. | |
| 2005/0048500 A1 | 3/2005 | Lawton | |
| 2005/0053952 A1 | 3/2005 | Hong et al. | |
| 2005/0105077 A1 | 5/2005 | Padmanabhan et al. | |
| 2005/0170373 A1 | 8/2005 | Monforte | |
| 2005/0175993 A1 | 8/2005 | Wei | |
| 2005/0196760 A1 | 9/2005 | Pemov et al. | |
| 2005/0214825 A1 | 9/2005 | Stuelpnagel | |
| 2005/0250146 A1 | 11/2005 | McMillan | |
| 2005/0250147 A1 | 11/2005 | Macevicz | |
| 2006/0002824 A1 | 1/2006 | Chang et al. | |
| 2006/0035258 A1 | 2/2006 | Tadakamalla et al. | |
| 2006/0040297 A1 | 2/2006 | Leamon et al. | |
| 2006/0041385 A1 | 2/2006 | Bauer | |
| 2006/0057634 A1 | 3/2006 | Rye | |
| 2006/0073506 A1 | 4/2006 | Christians et al. | |
| 2006/0211030 A1 | 9/2006 | Brenner | |
| 2006/0257902 A1 | 11/2006 | Mendoza et al. | |
| 2006/0263709 A1 | 11/2006 | Matsumura et al. | |
| 2006/0263789 A1 | 11/2006 | Kincaid | |
| 2006/0280352 A1 | 12/2006 | Muschler et al. | |
| 2006/0281092 A1 | 12/2006 | Wille et al. | |
| 2006/0286570 A1 | 12/2006 | Rowlen et al. | |
| 2007/0020640 A1 | 1/2007 | Mccloskey et al. | |
| 2007/0031829 A1 | 2/2007 | Yasuno et al. | |
| 2007/0042400 A1 | 2/2007 | Choi et al. | |
| 2007/0042419 A1 | 2/2007 | Barany et al. | |
| 2007/0065823 A1 | 3/2007 | Dressman et al. | |
| 2007/0065844 A1 | 3/2007 | Golub et al. | |
| 2007/0105090 A1 | 5/2007 | Cassidy et al. | |
| 2007/0117121 A1 | 5/2007 | Hutchison et al. | |
| 2007/0117134 A1 | 5/2007 | Kou | |
| 2007/0117177 A1 | 5/2007 | Luo et al. | |
| 2007/0133856 A1 | 6/2007 | Dutta-Choudhury | |
| 2007/0172873 A1 | 7/2007 | Brenner et al. | |
| 2007/0178478 A1 | 8/2007 | Dhallan et al. | |
| 2007/0202523 A1 | 8/2007 | Becker et al. | |
| 2007/0281317 A1 | 12/2007 | Becker et al. | |
| 2008/0038727 A1 | 2/2008 | Spier | |
| 2008/0070303 A1 | 3/2008 | West et al. | |
| 2008/0119736 A1 | 5/2008 | Dentinger | |
| 2008/0194414 A1 | 8/2008 | Albert et al. | |
| 2008/0261204 A1 | 10/2008 | Lexow | |
| 2008/0268508 A1 | 10/2008 | Sowlay | |
| 2008/0269068 A1 | 10/2008 | Church et al. | |
| 2008/0274458 A1 | 11/2008 | Latham et al. | |
| 2008/0299609 A1 | 12/2008 | Kwon et al. | |
| 2008/0318802 A1 | 12/2008 | Brenner | |
| 2009/0053669 A1 | 2/2009 | Liu et al. | |
| 2009/0061513 A1 | 3/2009 | Andersson Svahn et al. | |
| 2009/0105959 A1 | 4/2009 | Braverman et al. | |
| 2009/0131269 A1 | 5/2009 | Martin et al. | |
| 2009/0137407 A1 | 5/2009 | Church et al. | |
| 2009/0208936 A1 | 8/2009 | Tan et al. | |
| 2009/0220385 A1 | 9/2009 | Brown et al. | |
| 2009/0226891 A2 | 9/2009 | Nova et al. | |
| 2009/0252414 A1 | 10/2009 | Suzuki | |
| 2009/0253586 A1 | 10/2009 | Nelson et al. | |
| 2009/0283676 A1 | 11/2009 | Skoglund | |
| 2009/0290151 A1 | 11/2009 | Agrawal et al. | |
| 2009/0298709 A1 | 12/2009 | Ma | |
| 2009/0311694 A1 | 12/2009 | Gallagher et al. | |
| 2010/0069250 A1 | 3/2010 | White, III | |
| 2010/0105049 A1 | 4/2010 | Ehrich et al. | |
| 2010/0105112 A1 | 4/2010 | Holtze et al. | |
| 2010/0105886 A1 | 4/2010 | Woudenberg et al. | |
| 2010/0120098 A1 | 5/2010 | Grunenwald et al. | |
| 2010/0120630 A1 | 5/2010 | Huang et al. | |
| 2010/0136544 A1 | 6/2010 | Agresti et al. | |
| 2010/0159533 A1 | 6/2010 | Lipson et al. | |
| 2010/0167354 A1 | 7/2010 | Kurn | |
| 2010/0184076 A1 | 7/2010 | Lawton | |

(56) References Cited

U.S. PATENT DOCUMENTS

| | | |
|---|---|---|
| 2010/0255471 A1 | 10/2010 | Clarke |
| 2010/0267028 A1 | 10/2010 | Pasche |
| 2010/0291666 A1 | 11/2010 | Collier et al. |
| 2010/0300895 A1 | 12/2010 | Nobile et al. |
| 2010/0323348 A1 | 12/2010 | Hamady et al. |
| 2010/0330574 A1 | 12/2010 | Whitman |
| 2011/0038507 A1 | 2/2011 | Hager |
| 2011/0059436 A1 | 3/2011 | Hardin et al. |
| 2011/0059556 A1 | 3/2011 | Strey |
| 2011/0070584 A1 | 3/2011 | Wohlgemuth et al. |
| 2011/0072889 A1 | 3/2011 | Albitar et al. |
| 2011/0160078 A1 | 6/2011 | Fodor et al. |
| 2011/0201507 A1 | 8/2011 | Rava et al. |
| 2011/0230358 A1 | 9/2011 | Rava |
| 2011/0244455 A1 | 10/2011 | Larson et al. |
| 2011/0245111 A1 | 10/2011 | Chee |
| 2011/0263457 A1 | 10/2011 | Krutzik et al. |
| 2011/0294689 A1 | 12/2011 | Namsaraev |
| 2011/0312511 A1 | 12/2011 | Winquist et al. |
| 2011/0319289 A1 | 12/2011 | Libutti |
| 2012/0004132 A1 | 1/2012 | Zhang et al. |
| 2012/0010091 A1 | 1/2012 | Linnarson |
| 2012/0014977 A1 | 1/2012 | Furihata et al. |
| 2012/0034607 A1 | 2/2012 | Rothberg et al. |
| 2012/0040843 A1 | 2/2012 | Ducree et al. |
| 2012/0045844 A1 | 2/2012 | Rothberg et al. |
| 2012/0058520 A1 | 3/2012 | Hayashida |
| 2012/0058902 A1 | 3/2012 | Livingston et al. |
| 2012/0065081 A1 | 3/2012 | Chee |
| 2012/0071331 A1 | 3/2012 | Casbon |
| 2012/0087862 A1 | 4/2012 | Hood et al. |
| 2012/0142018 A1 | 6/2012 | Jiang |
| 2012/0149603 A1 | 6/2012 | Cooney et al. |
| 2012/0156675 A1 | 6/2012 | Lueerssen et al. |
| 2012/0163681 A1 | 6/2012 | Lohse |
| 2012/0165219 A1 | 6/2012 | Van Der Zaag et al. |
| 2012/0173159 A1 | 7/2012 | Davey et al. |
| 2012/0190020 A1 | 7/2012 | Oliphant et al. |
| 2012/0202293 A1 | 8/2012 | Martin et al. |
| 2012/0220022 A1 | 8/2012 | Ehrlich et al. |
| 2012/0220494 A1 | 8/2012 | Samuels et al. |
| 2012/0231972 A1 | 9/2012 | Golyshin et al. |
| 2012/0252012 A1 | 10/2012 | Armougom et al. |
| 2012/0253689 A1 | 10/2012 | Rogan |
| 2012/0316074 A1 | 12/2012 | Saxonov |
| 2012/0322681 A1 | 12/2012 | Kung et al. |
| 2013/0005585 A1 | 1/2013 | Anderson et al. |
| 2013/0022977 A1 | 1/2013 | Lapidus et al. |
| 2013/0045994 A1 | 2/2013 | Shinozuka et al. |
| 2013/0116130 A1 | 5/2013 | Fu et al. |
| 2013/0190206 A1 | 7/2013 | Leonard |
| 2013/0203047 A1 | 8/2013 | Casbon et al. |
| 2013/0210643 A1 | 8/2013 | Casbon et al. |
| 2013/0210659 A1 | 8/2013 | Watson et al. |
| 2013/0224743 A1 | 8/2013 | Casbon et al. |
| 2013/0225418 A1 | 8/2013 | Watson |
| 2013/0225623 A1 | 8/2013 | Buxbaum et al. |
| 2013/0237458 A1 | 9/2013 | Casbon et al. |
| 2013/0267424 A1 | 10/2013 | Casbon et al. |
| 2013/0274117 A1 | 10/2013 | Church |
| 2013/0323732 A1 | 12/2013 | Anderson et al. |
| 2014/0004569 A1 | 1/2014 | Lambowitz et al. |
| 2014/0057799 A1 | 2/2014 | Johnson et al. |
| 2014/0066318 A1 | 3/2014 | Frisen et al. |
| 2014/0147860 A1 | 5/2014 | Kaduchak et al. |
| 2014/0155274 A1 | 6/2014 | Xie et al. |
| 2014/0155295 A1 | 6/2014 | Hindson et al. |
| 2014/0178438 A1 | 6/2014 | Sahin et al. |
| 2014/0194324 A1 | 7/2014 | Gormley et al. |
| 2014/0206079 A1 | 7/2014 | Malinoski et al. |
| 2014/0206547 A1 | 7/2014 | Wang |
| 2014/0216128 A1 | 8/2014 | Trotter et al. |
| 2014/0227684 A1 | 8/2014 | Hindson et al. |
| 2014/0227705 A1 | 8/2014 | Vogelstein et al. |
| 2014/0228239 A1 | 8/2014 | McCoy et al. |
| 2014/0228255 A1 | 8/2014 | Hindson et al. |
| 2014/0235506 A1 | 8/2014 | Hindson et al. |
| 2014/0243242 A1 | 8/2014 | Nicol et al. |
| 2014/0244742 A1 | 8/2014 | Yu et al. |
| 2014/0272952 A1 | 9/2014 | May et al. |
| 2014/0274811 A1 | 9/2014 | Arnold |
| 2014/0287963 A1 | 9/2014 | Hindson et al. |
| 2014/0303005 A1 | 10/2014 | Samuels et al. |
| 2014/0309945 A1 | 10/2014 | Park et al. |
| 2014/0315211 A1 | 10/2014 | Sugino et al. |
| 2014/0322716 A1 | 10/2014 | Robins |
| 2014/0357500 A1 | 12/2014 | Vigneault et al. |
| 2014/0378322 A1 | 12/2014 | Hindson et al. |
| 2014/0378345 A1 | 12/2014 | Hindson et al. |
| 2014/0378349 A1 | 12/2014 | Hindson et al. |
| 2014/0378350 A1 | 12/2014 | Hindson et al. |
| 2015/0005185 A1 | 1/2015 | Fodor et al. |
| 2015/0005199 A1 | 1/2015 | Hindson et al. |
| 2015/0005200 A1 | 1/2015 | Hindson et al. |
| 2015/0011396 A1 | 1/2015 | Schroeder et al. |
| 2015/0017654 A1 | 1/2015 | Gorfinkel et al. |
| 2015/0066385 A1 | 3/2015 | Schnall-levin et al. |
| 2015/0072867 A1 | 3/2015 | Soldatov et al. |
| 2015/0072873 A1 | 3/2015 | Heinz et al. |
| 2015/0080266 A1 | 3/2015 | Volkmuth et al. |
| 2015/0099661 A1 | 4/2015 | Fodor et al. |
| 2015/0099673 A1 | 4/2015 | Fodor et al. |
| 2015/0111256 A1 | 4/2015 | Church et al. |
| 2015/0118680 A1 | 4/2015 | Fodor et al. |
| 2015/0119255 A1 | 4/2015 | Fodor et al. |
| 2015/0119256 A1 | 4/2015 | Fodor et al. |
| 2015/0119257 A1 | 4/2015 | Fodor et al. |
| 2015/0119258 A1 | 4/2015 | Fodor et al. |
| 2015/0119290 A1 | 4/2015 | Fodor et al. |
| 2015/0133319 A1 | 5/2015 | Fu et al. |
| 2015/0141292 A1 | 5/2015 | Fodor et al. |
| 2015/0152409 A1 | 6/2015 | Seitz et al. |
| 2015/0203897 A1 | 7/2015 | Robons et al. |
| 2015/0211050 A1 | 7/2015 | Iafrate et al. |
| 2015/0218620 A1 | 8/2015 | Behlke et al. |
| 2015/0225777 A1 | 8/2015 | Hindson et al. |
| 2015/0225778 A1 | 8/2015 | Hindson et al. |
| 2015/0247182 A1 | 9/2015 | Faham et al. |
| 2015/0253237 A1 | 9/2015 | Castellarnau et al. |
| 2015/0259734 A1 | 9/2015 | Asbury et al. |
| 2015/0275295 A1 | 10/2015 | Wang et al. |
| 2015/0298091 A1 | 10/2015 | Weitz |
| 2015/0299784 A1 | 10/2015 | Fan et al. |
| 2015/0307874 A1 | 10/2015 | Jaitin |
| 2015/0329852 A1 | 11/2015 | Nolan |
| 2015/0360193 A1 | 12/2015 | Fan et al. |
| 2015/0376609 A1 | 12/2015 | Hindson et al. |
| 2016/0010151 A1 | 1/2016 | Fan et al. |
| 2016/0017320 A1 | 1/2016 | Wang et al. |
| 2016/0026758 A1 | 1/2016 | Jabara et al. |
| 2016/0053253 A1 | 2/2016 | Salathia et al. |
| 2016/0055632 A1 | 2/2016 | Fu et al. |
| 2016/0060621 A1 | 3/2016 | Agresti et al. |
| 2016/0060682 A1 | 3/2016 | Pregibon et al. |
| 2016/0068889 A1 | 3/2016 | Gole et al. |
| 2016/0122751 A1 | 5/2016 | LaBaer |
| 2016/0122753 A1 | 5/2016 | Mikkelsen et al. |
| 2016/0138091 A1 | 5/2016 | Chee et al. |
| 2016/0145677 A1 | 5/2016 | Chee et al. |
| 2016/0145683 A1 | 5/2016 | Fan et al. |
| 2016/0153973 A1 | 6/2016 | Smith |
| 2016/0201125 A1 | 7/2016 | Samuels et al. |
| 2016/0208322 A1 | 7/2016 | Anderson et al. |
| 2016/0222378 A1 | 8/2016 | Fodor et al. |
| 2016/0232291 A1 | 8/2016 | Kyriazopoulou-Panagiotopoulou et al. |
| 2016/0244742 A1 | 8/2016 | Linnarsson et al. |
| 2016/0244828 A1 | 8/2016 | Mason |
| 2016/0253584 A1 | 9/2016 | Fodor et al. |
| 2016/0257993 A1 | 9/2016 | Fu et al. |
| 2016/0258012 A2 | 9/2016 | Fodor et al. |
| 2016/0265027 A1 | 9/2016 | Sanches-Kuiper et al. |
| 2016/0265069 A1 | 9/2016 | Fan et al. |
| 2016/0266094 A1 | 9/2016 | Ankrum et al. |

(56) References Cited

U.S. PATENT DOCUMENTS

| | | |
|---|---|---|
| 2016/0289669 A1 | 10/2016 | Fan et al. |
| 2016/0289670 A1 | 10/2016 | Samuels et al. |
| 2016/0289740 A1 | 10/2016 | Fu et al. |
| 2016/0298180 A1 | 10/2016 | Chee |
| 2016/0312276 A1 | 10/2016 | Fu et al. |
| 2016/0320720 A1 | 11/2016 | Murata et al. |
| 2016/0326584 A1 | 11/2016 | Fodor et al. |
| 2016/0355879 A1 | 12/2016 | Kamberov et al. |
| 2016/0362730 A1 | 12/2016 | Alexander et al. |
| 2016/0376583 A1 | 12/2016 | Fodor et al. |
| 2016/0376648 A1 | 12/2016 | Fodor et al. |
| 2017/0044525 A1 | 2/2017 | Kaper et al. |
| 2017/0073730 A1 | 3/2017 | Betts et al. |
| 2017/0136458 A1 | 5/2017 | Dunne et al. |
| 2017/0154421 A1 | 6/2017 | Fu et al. |
| 2017/0192013 A1 | 7/2017 | Agresti et al. |
| 2017/0260584 A1 | 9/2017 | Zheng et al. |
| 2017/0275669 A1 | 9/2017 | Weissleder et al. |
| 2017/0314067 A1 | 11/2017 | Shum et al. |
| 2017/0337459 A1 | 11/2017 | Fodor et al. |
| 2017/0342405 A1 | 11/2017 | Fu et al. |
| 2017/0342465 A1 | 11/2017 | Shum et al. |
| 2017/0342484 A1 | 11/2017 | Shum et al. |
| 2017/0344866 A1 | 11/2017 | Fan et al. |
| 2018/0002764 A1 | 1/2018 | Fan et al. |
| 2018/0016634 A1 | 1/2018 | Hindson et al. |
| 2018/0024139 A1 | 1/2018 | Peikon et al. |
| 2018/0030522 A1 | 2/2018 | Kamberov et al. |
| 2018/0037942 A1 | 2/2018 | Fu et al. |
| 2018/0057873 A1 | 3/2018 | Zhou et al. |
| 2018/0088112 A1 | 3/2018 | Fan et al. |
| 2018/0094312 A1 | 4/2018 | Hindson et al. |
| 2018/0094314 A1 | 4/2018 | Hindson et al. |
| 2018/0094315 A1 | 4/2018 | Hindson et al. |
| 2018/0105808 A1 | 4/2018 | Mikkelsen et al. |
| 2018/0112266 A1 | 4/2018 | Hindson et al. |
| 2018/0127743 A1 | 5/2018 | Vigneault et al. |
| 2018/0142292 A1 | 5/2018 | Hindson et al. |
| 2018/0163201 A1 | 6/2018 | Larson |
| 2018/0179590 A1 | 6/2018 | Belgrader et al. |
| 2018/0179591 A1 | 6/2018 | Belgrader et al. |
| 2018/0201923 A1 | 7/2018 | LaBaer |
| 2018/0201980 A1 | 7/2018 | Chee et al. |
| 2018/0208975 A1 | 7/2018 | Peterson et al. |
| 2018/0216174 A1 | 8/2018 | Shum et al. |
| 2018/0230527 A1 | 8/2018 | Fang et al. |
| 2018/0251825 A1 | 9/2018 | Stoeckius et al. |
| 2018/0258482 A1 | 9/2018 | Hindson et al. |
| 2018/0258500 A1 | 9/2018 | Fan et al. |
| 2018/0267036 A1 | 9/2018 | Fan et al. |
| 2018/0276332 A1 | 9/2018 | Fan et al. |
| 2018/0282803 A1 | 10/2018 | Belgrader et al. |
| 2018/0291470 A1 | 10/2018 | Fan et al. |
| 2018/0002738 A1 | 11/2018 | Wang et al. |
| 2018/0320241 A1 | 11/2018 | Nolan et al. |
| 2018/0327835 A1 | 11/2018 | Fodor et al. |
| 2018/0327836 A1 | 11/2018 | Fodor et al. |
| 2018/0327866 A1 | 11/2018 | Fan et al. |
| 2018/0327867 A1 | 11/2018 | Fan et al. |
| 2018/0340170 A1 | 11/2018 | Belhocine et al. |
| 2018/0346969 A1 | 12/2018 | Chang et al. |
| 2018/0346970 A1 | 12/2018 | Chang et al. |
| 2018/0371536 A1 | 12/2018 | Fu et al. |
| 2019/0010552 A1 | 1/2019 | Xu et al. |
| 2019/0025304 A1 | 1/2019 | Vigneault et al. |
| 2019/0032129 A1 | 1/2019 | Hindson et al. |
| 2019/0040474 A1 | 2/2019 | Fan et al. |
| 2019/0085412 A1 | 3/2019 | Fan et al. |
| 2019/0095578 A1 | 3/2019 | Shum et al. |
| 2019/0100798 A1 | 4/2019 | Fodor et al. |
| 2019/0119726 A1 | 4/2019 | Shum et al. |
| 2019/0136316 A1 | 5/2019 | Hindson et al. |
| 2019/0136317 A1 | 5/2019 | Hindson et al. |
| 2019/0136319 A1 | 5/2019 | Hindson et al. |
| 2019/0161743 A1 | 5/2019 | Church et al. |
| 2019/0177788 A1 | 6/2019 | Hindson et al. |
| 2019/0177800 A1 | 6/2019 | Boutet et al. |
| 2019/0203270 A1 | 7/2019 | Amit et al. |
| 2019/0203291 A1 | 7/2019 | Hindson et al. |
| 2019/0211395 A1 | 7/2019 | Tsao et al. |
| 2019/0218276 A1 | 7/2019 | Regev et al. |
| 2019/0218607 A1 | 7/2019 | Love et al. |
| 2019/0221287 A1 | 7/2019 | Tsujimoto |
| 2019/0221292 A1 | 7/2019 | Tsujimoto |
| 2019/0256888 A1 | 8/2019 | Weissleder et al. |
| 2019/0256907 A1 | 8/2019 | Ryan et al. |
| 2019/0292592 A1 | 9/2019 | Shum et al. |
| 2019/0338278 A1 | 11/2019 | Shum et al. |
| 2019/0338353 A1 | 11/2019 | Belgrader et al. |
| 2019/0338357 A1 | 11/2019 | Fan et al. |
| 2019/0390253 A1 | 12/2019 | Kennedy et al. |
| 2020/0102598 A1 | 4/2020 | Xie et al. |
| 2020/0109437 A1 | 4/2020 | Chang et al. |
| 2020/0115753 A1 | 4/2020 | Shalek et al. |
| 2020/0124601 A1 | 4/2020 | Fan et al. |
| 2021/0039582 A1 | 2/2021 | Patton et al. |
| 2021/0123044 A1 | 4/2021 | Zhang et al. |
| 2021/0132078 A1 | 5/2021 | Peikon et al. |
| 2021/0198754 A1 | 7/2021 | Fan et al. |
| 2021/0213413 A1 | 7/2021 | Saligrama et al. |
| 2021/0222163 A1 | 7/2021 | Wu et al. |
| 2021/0371914 A1 | 12/2021 | Stoeckius et al. |
| 2022/0010361 A1 | 1/2022 | Song et al. |
| 2022/0010362 A1 | 1/2022 | Campbell |
| 2022/0033810 A1 | 2/2022 | Song et al. |
| 2022/0154288 A1 | 5/2022 | Mortimer |
| 2022/0162695 A1 | 5/2022 | Sakofsky et al. |
| 2022/0162773 A1 | 5/2022 | Sakofsky et al. |
| 2022/0178909 A1 | 6/2022 | Huang et al. |
| 2022/0214356 A1 | 7/2022 | Henikoff et al. |
| 2022/0219170 A1 | 7/2022 | Khurana et al. |
| 2022/0220549 A1 | 7/2022 | Shum et al. |
| 2022/0267759 A1 | 8/2022 | Sanjana et al. |
| 2022/0333185 A1 | 10/2022 | Fu et al. |
| 2022/0348904 A1 | 11/2022 | Shum et al. |
| 2023/0083422 A1 | 3/2023 | Fu et al. |
| 2023/0109336 A1 | 4/2023 | Shum et al. |
| 2023/0125113 A1 | 4/2023 | Fan et al. |
| 2023/0193372 A1 | 6/2023 | Shum et al. |

FOREIGN PATENT DOCUMENTS

| | | |
|---|---|---|
| CN | 106460033 A | 2/2017 |
| CN | 107208158 A | 9/2017 |
| CN | 110498858 A | 11/2019 |
| DE | 102008025656 | 12/2009 |
| EP | 1473080 | 11/2004 |
| EP | 1647600 | 4/2006 |
| EP | 1845160 | 10/2007 |
| EP | 2036989 | 3/2009 |
| EP | 1379693 | 5/2009 |
| EP | 2204456 | 7/2010 |
| EP | 2431465 | 3/2012 |
| EP | 2203749 | 8/2012 |
| EP | 2511708 | 10/2012 |
| EP | 2538220 | 12/2012 |
| EP | 2623613 | 8/2013 |
| EP | 2702146 | 3/2014 |
| EP | 1745155 | 10/2014 |
| EP | 2805769 | 11/2014 |
| EP | 2556171 | 9/2015 |
| EP | 2989215 | 3/2016 |
| EP | 2970958 | 12/2017 |
| EP | 3263715 | 1/2018 |
| EP | 3286326 | 2/2018 |
| EP | 2670863 B1 | 6/2018 |
| EP | 3136103 | 8/2018 |
| EP | 3256606 | 8/2018 |
| EP | 2954102 | 12/2018 |
| EP | 3428290 | 1/2019 |
| EP | 2970957 | 4/2019 |
| EP | 3058092 | 5/2019 |
| EP | 3327123 | 8/2019 |
| GB | 2293238 A | 3/1996 |

(56) References Cited

FOREIGN PATENT DOCUMENTS

| | | |
|---|---|---|
| JP | 2001078768 A | 3/2001 |
| JP | 2005233974 | 9/2005 |
| JP | 2007504831 | 3/2007 |
| JP | 2008256428 | 10/2008 |
| JP | 2013039275 | 2/2013 |
| JP | 2018509896 A | 4/2018 |
| JP | 2019522268 | 8/2019 |
| WO | WO1989001050 | 2/1989 |
| WO | WO1996024061 | 8/1996 |
| WO | WO1997010365 | 3/1997 |
| WO | WO1999015702 | 4/1999 |
| WO | WO1999028505 | 6/1999 |
| WO | WO2000058516 | 10/2000 |
| WO | WO2001020035 | 3/2001 |
| WO | WO2001048242 | 7/2001 |
| WO | WO2001053539 | 7/2001 |
| WO | WO2002018643 | 3/2002 |
| WO | WO2002046472 | 6/2002 |
| WO | WO2002056014 | 7/2002 |
| WO | WO2002059355 | 8/2002 |
| WO | WO2002070684 | 9/2002 |
| WO | WO2002072772 | 9/2002 |
| WO | WO2002079490 | 10/2002 |
| WO | WO2002083922 | 10/2002 |
| WO | WO2002101358 | 12/2002 |
| WO | WO2003031591 | 4/2003 |
| WO | WO2003035829 | 5/2003 |
| WO | WO2004017374 | 2/2004 |
| WO | WO2004021986 | 3/2004 |
| WO | WO2004033669 | 4/2004 |
| WO | WO2004066185 | 8/2004 |
| WO | WO2004081225 | 9/2004 |
| WO | WO2005017206 | 2/2005 |
| WO | WO2005021731 | 3/2005 |
| WO | WO2005042759 | 5/2005 |
| WO | WO2005071110 | 8/2005 |
| WO | WO2005080604 | 9/2005 |
| WO | WO2005111242 | 11/2005 |
| WO | WO2005111243 | 11/2005 |
| WO | WO2006026828 | 3/2006 |
| WO | WO2006071776 | 7/2006 |
| WO | WO2006102264 | 9/2006 |
| WO | WO2006137932 | 12/2006 |
| WO | WO2007087310 | 8/2007 |
| WO | WO2007087312 | 8/2007 |
| WO | WO2007147079 | 12/2007 |
| WO | WO2008047428 | 4/2008 |
| WO | WO2008051928 | 5/2008 |
| WO | WO2008057163 | 5/2008 |
| WO | WO2008096318 | 8/2008 |
| WO | WO2008104380 | 9/2008 |
| WO | WO2008147428 | 12/2008 |
| WO | WO2008150432 | 12/2008 |
| WO | WO2009048530 | 4/2009 |
| WO | WO2009148560 | 12/2009 |
| WO | WO2009152928 | 12/2009 |
| WO | WO2010048605 | 4/2010 |
| WO | WO2010059820 | 5/2010 |
| WO | WO2010117620 | 10/2010 |
| WO | WO2010131645 | 11/2010 |
| WO | WO2011091393 | 7/2011 |
| WO | WO2011106738 | 9/2011 |
| WO | WO2011123246 | 10/2011 |
| WO | WO2011127099 | 10/2011 |
| WO | WO2011143659 | 11/2011 |
| WO | WO2011155833 | 12/2011 |
| WO | WO2012038839 | 3/2012 |
| WO | WO2012042374 | 4/2012 |
| WO | WO2012047297 | 4/2012 |
| WO | WO2012048341 | 4/2012 |
| WO | WO2012041802 | 5/2012 |
| WO | WO2012083225 | 6/2012 |
| WO | WO2012099896 | 7/2012 |
| WO | WO2012103154 | 8/2012 |
| WO | WO2012106385 | 8/2012 |
| WO | WO2012106546 | 8/2012 |
| WO | WO2012108864 | 8/2012 |
| WO | WO2012112804 | 8/2012 |
| WO | WO2012129363 | 9/2012 |
| WO | WO2012140224 | 10/2012 |
| WO | WO2012142213 | 10/2012 |
| WO | WO2012148477 | 11/2012 |
| WO | WO2012149042 | 11/2012 |
| WO | WO2012156744 | 11/2012 |
| WO | WO2012162267 | 11/2012 |
| WO | WO2012177639 | 12/2012 |
| WO | WO2013019075 | 2/2013 |
| WO | WO2013070990 | 5/2013 |
| WO | WO2013096802 | 6/2013 |
| WO | WO2013117595 | 8/2013 |
| WO | WO2013130674 | 9/2013 |
| WO | WO2013148525 | 10/2013 |
| WO | WO2013173394 | 11/2013 |
| WO | WO2013176767 | 11/2013 |
| WO | WO2013177206 | 11/2013 |
| WO | WO2013188831 | 12/2013 |
| WO | WO2013188872 | 12/2013 |
| WO | WO2013191775 | 12/2013 |
| WO | WO2014015084 | 1/2014 |
| WO | WO2014015098 | 1/2014 |
| WO | WO2014018093 | 1/2014 |
| WO | WO2014018460 | 1/2014 |
| WO | WO2014028537 | 2/2014 |
| WO | WO2014031997 | 2/2014 |
| WO | WO2014065756 | 5/2014 |
| WO | WO2014093676 | 6/2014 |
| WO | WO2014108850 | 7/2014 |
| WO | WO2014124046 | 8/2014 |
| WO | WO2014124336 | 8/2014 |
| WO | WO2014124338 | 8/2014 |
| WO | WO2014126937 | 8/2014 |
| WO | WO2014144495 | 9/2014 |
| WO | WO2014145458 | 9/2014 |
| WO | WO2014200767 | 12/2014 |
| WO | WO2014201273 | 12/2014 |
| WO | WO2014204939 | 12/2014 |
| WO | WO2014210223 | 12/2014 |
| WO | WO2014210225 | 12/2014 |
| WO | WO2014210353 | 12/2014 |
| WO | WO2015002908 | 1/2015 |
| WO | WO2018015365 | 1/2015 |
| WO | WO2015017586 | 2/2015 |
| WO | WO2015031691 | 3/2015 |
| WO | WO2015035087 | 3/2015 |
| WO | WO2015044428 | 4/2015 |
| WO | WO2015047186 | 4/2015 |
| WO | WO2015057985 | 4/2015 |
| WO | WO2014071361 | 5/2015 |
| WO | WO2015061844 | 5/2015 |
| WO | WO2015103339 | 7/2015 |
| WO | WO2015117163 | 8/2015 |
| WO | WO2015134787 | 9/2015 |
| WO | WO2015160439 | 10/2015 |
| WO | WO2015168161 | 11/2015 |
| WO | WO2015179339 | 11/2015 |
| WO | WO2015200869 | 12/2015 |
| WO | WO2015200893 | 12/2015 |
| WO | WO2016044227 | 3/2016 |
| WO | WO2016049418 | 3/2016 |
| WO | WO2016061517 | 4/2016 |
| WO | WO2016100976 | 6/2016 |
| WO | WO2016118915 | 7/2016 |
| WO | WO2016126871 | 8/2016 |
| WO | WO2016130578 | 8/2016 |
| WO | WO2016160965 | 8/2016 |
| WO | WO2016138496 | 9/2016 |
| WO | WO2016138500 | 9/2016 |
| WO | WO2016145409 | 9/2016 |
| WO | WO2016149418 | 9/2016 |
| WO | WO2016160844 | 10/2016 |
| WO | WO2016168825 | 10/2016 |
| WO | WO2016176091 | 11/2016 |
| WO | WO2016190795 | 12/2016 |
| WO | WO2016191272 | 12/2016 |

(56) References Cited

FOREIGN PATENT DOCUMENTS

| | | |
|---|---|---|
| WO | WO2017032808 | 3/2017 |
| WO | WO2017040306 | 3/2017 |
| WO | WO2017044574 | 3/2017 |
| WO | WO2017053905 | 3/2017 |
| WO | WO2017079593 | 5/2017 |
| WO | WO2017087873 | 5/2017 |
| WO | WO2017096239 | 6/2017 |
| WO | WO2017097939 | 6/2017 |
| WO | WO2017117358 | 7/2017 |
| WO | WO2017125508 | 7/2017 |
| WO | WO2017139690 | 8/2017 |
| WO | WO2017164936 | 9/2017 |
| WO | WO2017173328 | 10/2017 |
| WO | WO2017205691 | 11/2017 |
| WO | WO2018017949 | 1/2018 |
| WO | WO2018018008 | 1/2018 |
| WO | WO2018020489 | 2/2018 |
| WO | WO2018031631 | 2/2018 |
| WO | WO2018058073 | 3/2018 |
| WO | WO2018064640 | 4/2018 |
| WO | WO2018075693 | 4/2018 |
| WO | WO2018111872 | 6/2018 |
| WO | WO2018115852 | 6/2018 |
| WO | WO2018119447 | 6/2018 |
| WO | WO2018132635 | 7/2018 |
| WO | WO2018140966 | 8/2018 |
| WO | WO2018144240 | 8/2018 |
| WO | WO2018144813 | 8/2018 |
| WO | WO2018174827 | 9/2018 |
| WO | WO2018217862 | 11/2018 |
| WO | WO2018218222 | 11/2018 |
| WO | WO2018222548 | 12/2018 |
| WO | WO2018226293 | 12/2018 |
| WO | WO2019055852 | 3/2019 |
| WO | WO2019076768 | 4/2019 |
| WO | WO2019084046 | 5/2019 |
| WO | WO2019099906 | 5/2019 |
| WO | WO2019113457 | 6/2019 |
| WO | WO2019113499 | 6/2019 |
| WO | WO2019113506 | 6/2019 |
| WO | WO2019113533 | 6/2019 |
| WO | WO2019118355 | 6/2019 |
| WO | WO2019126789 | 6/2019 |
| WO | WO2019157529 | 8/2019 |
| WO | WO2013137737 | 9/2019 |
| WO | WO2019178164 | 9/2019 |
| WO | WO2019213237 | 11/2019 |
| WO | WO2019213294 | 11/2019 |
| WO | WO2019218101 | 11/2019 |
| WO | WO2020028266 | 2/2020 |
| WO | WO2020033164 | 2/2020 |
| WO | WO2020037065 | 2/2020 |
| WO | WO2020046833 | 3/2020 |
| WO | WO2020072380 | 4/2020 |
| WO | WO2020097315 | 5/2020 |
| WO | WO2020123384 | 6/2020 |
| WO | WO2020131699 | 6/2020 |
| WO | WO2020154247 | 7/2020 |
| WO | WO2020159757 | 8/2020 |
| WO | WO2020167920 | 8/2020 |
| WO | WO2020214642 | 10/2020 |
| WO | WO2020219721 | 10/2020 |
| WO | WO2020242377 | 12/2020 |
| WO | WO2021092386 | 5/2021 |
| WO | WO2021142233 | 7/2021 |
| WO | WO2021146207 | 7/2021 |
| WO | WO2021146219 | 7/2021 |
| WO | WO2021146636 | 7/2021 |
| WO | WO2021155057 | 8/2021 |
| WO | WO2021155284 | 8/2021 |
| WO | WO2021163374 | 8/2021 |
| WO | WO2021168015 | 8/2021 |
| WO | WO2021168261 | 8/2021 |
| WO | WO2021178199 | 9/2021 |
| WO | WO2021247593 | 12/2021 |
| WO | WO2021257795 | 12/2021 |
| WO | WO2022015667 | 1/2022 |
| WO | WO2022026909 | 2/2022 |
| WO | WO2022040453 | 2/2022 |
| WO | WO2022115608 A1 | 2/2022 |
| WO | WO2022115608 A9 | 2/2022 |
| WO | WO2022076912 | 4/2022 |
| WO | WO2022132206 | 6/2022 |
| WO | WO2022143221 | 7/2022 |
| WO | WO2022256324 | 12/2022 |
| WO | WO2023034739 | 3/2023 |
| WO | WO2023034789 | 3/2023 |
| WO | WO2023034790 | 3/2023 |
| WO | WO2023034794 | 3/2023 |
| WO | WO2023034872 | 3/2023 |
| WO | WO2023039433 | 3/2023 |

OTHER PUBLICATIONS

10x_LIT099_Product-Sheet_Chromium-Single-Cell-Multiome-ATAC-Gene-Expression_Letter_digital.

Achim et al., "High-throughput spatial mapping of single-cell RNA-seq data to tissue of origin," Nature Biotechnology 2015, 33(5), 503-511.

Adey et al., "Rapid, low-input, low-bias construction of shotgun fragment libraries by high-density in vitro transposition," Genome Biology 2010, 11(R19), in 17 pages.

Advisory Action dated Dec. 2, 2019 in U.S. Appl. No. 15/055,407.

Advisory Action dated Nov. 29, 2019 in U.S. Appl. No. 15/084,307.

Advisory Action dated Aug. 25, 2020 in U.S. Appl. No. 15/084,307.

Advisory Action dated May 31, 2023 in U.S. Appl. No. 16/789,311.

Agasti et al., "Photocleavable DNA barcode-antibody conjugates allow sensitive and multiplexed protein analysis in single cell," J Am Chem Soc. 2012, 134(45), 18499-18502.

Ahern, "Biochemical, Reagent Kits Offer Scientists Good Return on Investment," The Scientist 1995, 9(15), in 5 pages.

Alexandra M. Ewing of Richards, Layton and Finger, P.A., Entry of Appearance dated Jan. 18, 2019 in the USDC District of Delaware, C.A. No. 18-1800-RGA, 1 pp.

Alkan et al., "Personalized copy number and segmental duplication maps using next-generation sequencing," Nat Genet. 2009, 41(10):1061-1067.

Anderson, "Study Describes RNA Sequencing Applications for Molecular Indexing Methods," GenomeWeb 2014, 5 pp.

Ansorge, "Next-generation DNA sequencing techniques," New Biotechnology 2009, 25(4), 195-203.

Applied Biosystems, Apr. 2008, SOLiD™ System Barcoding, Application Note, 4 pp.

Argrawal et al., "Counting Single Native Biomolecules and Intact Viruses with Color-Coded Nanoparticles," Analytical Chemistry 2006, 78, 1061-1070.

Arguel et al., "A cost effective 5' selective single cell transcriptome profiling approach with improved UMI design," Nucleic Acids Research 2017, 45(7), e48, in 11 pages.

Arslan et al., "An efficient algorithm for the stochastic simulation of the hybridization of DNA to microarrays," BMC Bioinformatics 2009, 10(411), 1-17.

Armbrecht, et al. "Single-cell protein profiling in microchambers with barcoded beads", Microsystems & Nanoengineering, 2019, 5:55.

Atanur et al., "The genome sequence of the spontaneously hypertensive rat: Analysis and functional significance." Genome Res. 2010, 20(6), 791-803.

Audic et al., "The Significance of Digital Gene Expression Profiles," Genome Res. 1997, 7, 986-995.

Baek et al., "Development of Hydrogel TentaGel Shell-Core Beads for Ultra-high Throughput Solution Phase Screening of Encoded OBOC Combinatorial Small Molecule Libraries," J. Comb Chem. 2009, 11(1), 91-102.

BD Life Sciences, 2018, BD AbSeq antibody-oligo conjugates, www.bd.com/genomics, 2 pp.

(56) References Cited

OTHER PUBLICATIONS

BD Life Sciences, 2018, BD AbSeq on the BD Rhapsody system: Exploration of single-cell gene regulation by simultaneous digital mRNA and protein quantification, www.bd.com/genomics, 7 pp.
Bendall et al., "Single-cell mass cytometry of differential immune and drug responses across a human hematopoietic continuum," Science 2011, 332(6030), 687-696.
Bionumbers, "Useful fundamental numbers in molecular biology," http://bionumbers.hms.harvard.edu/KeyNumbers/aspx, 1-4.
Biosciences Product Catalogue, Dynal® Catalog 1999, Oslo, Norway, 49-51.
Bioscribe "Massively parallel sequencing technology for single-cell gene expression published" (press release), PhysOrg 2015, 1-2.
Blainey, "The future is now: single-cell genomics of bacteria and archaea," FEMS Microbiol Rev. 2013, 37(3), 407-427.
Bogdanova et al., "Normalization of full-length enriched cDNA," Molecular Biosystems 2008, 4(3), 205-212.
Bolivar et al., "Targeted next-generation sequencing of endometrial cancer and matched circulating tumor DNA: identification of plasma-based, tumor-associated mutations in early stage patients," Modern Pathology 2019, 32(3), 405-414.
Bonaldo et al., "Normalization and Subtraction: Two Approaches to facilitate Gene Discovery," Genome Res. 1996, 6, 791-806.
Bontoux et al., "Integrating whole transcriptome assays on a lab-on-a-chip for single cell gene profiling", Lab on a Chip 2008, 8(3), 443-450.
Bose et al., "Scalable microfluidics for single-cell RNA printing and sequencing," Genome Biology 2015, 16(120), 1-16.
Brady et al., "Construction of cDNA libraries form single cells", Methods in Enzymology 1993, (225), 611-623.
Braha et al., "Simultaneous stochastic sensing of divalent metal ions," Nature Biotechnology 2000, 18, 1005-1007.
Bratke et al., "Differential expression of human granzymes A, B, and K in natural killer cells and during CD8+ T cell differentiation in peripheral blood," Eur J Immunol. 2005, 35, 2608-2616.
Brenner et al., "Gene expression analysis by massively parallel signature sequencing (MPSS) on microbead arrays," Nature Biotechnology 2000, 18, 630-634.
Brenner et al., "In vitro cloning of complex mixtures of DNA on microbeads: Physical separation of differentially expressed cDNAs," PNAS 2000, 97(4), 1665-1670.
Brinza et al., "Detection of somatic mutations at 0.1% frequency from cfDNA in peripheral blood with a multiplex next-generation sequencing assay," Conference Poster, AACR 107th Annual Meeting, Apr. 16-20, 2016, 1 p.
Brisco et al., "Quantification of RNA integrity and its use for measurement of transcript number," Nucleic Acids Research 2012, 40(18), e144, 1-9.
Brodin et al., "Challenges with Using Primer IDs to Improve Accuracy of Next Generation Sequencing," PLoS One 2015, 19(3), 1-12.
Brouilette et al., "A Simple and Novel Method for RNA-seq Library Preparation of Single Cell cDNA Analysis by Hyperactive Tn5 Transposase," Developmental Dynamics 2012, 241, 1584-1590.
Buenrostro et al., "Transposition of native chromatin for multimodal regulatory analysis and personal epigenomics," Nat Methods 2013, 10(12), 1213-1218.
Buenrostro et al., "ATAC-seq: A Method for Assaying Chromatin Accessibility Genome-Wide," Curr Protoc Mol Biol 2016, 109, 1-21.
Buggenum et al., "A covalent and cleavable antibody DNA conjugation strategy for sensitive protein detection via immunoPCR," Scientific Reports 2016, 6(22675), 1-12.
Buschmann et al., Enhancing the detection of barcoded reads in high throughput DNA sequencing DNA by controlling the false discovery rate, BMC Bioinformatics, 15(1), 264, 1-16.
Bustin, "Absolute quantification of mRNA using real-time reverse transcription polymerase chain reaction assays," Journal of Molecular Endocrinology 2000, 25, 169-193.
Butkus, "Cellular research set to launch first gene expression platform using 'molecular indexing' technology," GenomeWeb 2014, 1-5.
Cai, "Turning single cells in microarrays by super-resolution barcoding," Briefings in Functional Genomics 2012, 12(2), 75-80.
Cao et al., "Comprehensive single-cell transcriptional profiling of a multicellular organism," Science 2017, 357, 661-667.
Carr et al., "Inferring relative proportions of DNA variants from sequencing electropherograms," Bioinformatics 2009, 25(24), 3244-3250.
Caruccio et al., "Nextera (TM) Technology for NGS DNA Library Preparation: Simultaneous Fragmentation and Tagging by in Vitro Transposition," EpiBio 2009, 16(3), 4-6.
Casbon et al., "A method for counting PCR template molecules with application to next-generation sequencing," Nucleic Acids Res. 2011, 39(12), e81, 1-8.
Castellarnau et al., "Stochastic particle barcoding for single-cell tracking and multiparametric analysis," Small 2015, 11(4), 489-498.
Castle et al., "DNA copy number, including telomeres and mitochondria, assayed using next-generation sequencing," BMC Genomics 2010, 11(244), 1-11.
CG000209_Chromium_NextGEM_SingleCell_ATAC_ReagentKits_v1.1_UserGuide_RevG.
CG000496_Chromium_NextGEM_SingleCell_ATAC_ReagentKits_v2_UserGuide_RevB.
CG000505_Chromium_Nuclei_Isolation_Kit_UG_RevA.
Chamberlain et al., "Deletion screening of the Duchenne muscular dystrophy locus via multiplex DNA amplification," Nucleic Acids Res. 1988, 16(23), 11141-11156.
Chang et al., "Detection of Allelic Imbalance in Ascitic Supernatant by Digital Single Nucleotide Polymorphism Analysis," Clinical Cancer Research, 8, 2580-2585.
Chang et al., "Single-cell protein and gene expression profiling of stem memory T cells by BD Ab-seq," Annual Joint Meeting of the American Society for Cell Biology and the European Molecular Biology Organization 2017, 28(26), p. 1896.
Chapin et al., "Rapid microRNA Profiling on Encoded Gel Microparticles," Angew Chem Int Ed Engl. 2011, 50(10), 2289-2293.
Chee et al., "Accessing genetic information with high-density DNA arrays," Science 1996, 274, 610-614.
Chee, "Enzymatic multiplex DNA sequencing," Nucleic Acids Research 1991, 19(12), 3301-3305.
Chen et al., "Spatially resolved, highly multiplexed RNA profiling in single cells," Science Express 2015, 348(6233), aaa6090, 1-36.
Chen et al., "High-throughput sequencing of the transcriptome and chromatin accessibility in the same cell," Nature Biotechnology 2019, 37, 1452-1457.
Chen et al., "Single-Cell Protein Secretion Detection and Profiling", Annual Reviews, Anal. Chem, 2019, 12, 431-449.
Church et al., "Multiplex DNA sequencing," Science 1988, 240(4849), 185-188.
Civil Cover Sheet filed Nov. 15, 2018 in the USDC for the District of Delaware, C.A. 18-1800-RGA, 1 pp.
Clontech Laboratories, Inc., "SMART™ PCR cDNA Synthesis Kit User Manual," Clontech 2007, 1-39.
Cloonan et al., "Stem cell transcriptome profiling via massive-scale mRNA sequencing", Nature Methods 2008, 5(7), 613-619.
Combined Search and Examination Report dated Aug. 6, 2014 in UK Patent Application No. 1408829.8.
Combined Search and Examination Report dated Feb. 21, 2017 in UK Patent Application No. 1609740.4.
Communication of a Notice of Opposition dated Jul. 27, 2016 in European Patent Application No. EP 10762102.1.
Complaint filed in *Becton, Dickinson and Company and Cellular Research Inc. v. 10X Genomics, Inc.* dated Nov. 15, 2018 in the USDC for the District of Delaware, C.A. 18-1800-RGA, 141 pp.
Costa et al., "Single-Tube Nested Real-Time PCR as a New Highly Sensitive Approach to Trace Hazelnut," Journal of Agricultural and Food Chemistry 2012, 60, 8103-8110.

(56) References Cited

OTHER PUBLICATIONS

Costello et al., "Discovery and characterization of artefactual mutations in deep coverage targeted capture sequencing data due to oxidative DNA damage during sample preparation," Nucleic Acids Res 2013, 41(6), e67, 1-12.

Cotten et al., "Selection of proteins with desired properties from natural proteome libraries using mRNA display," Nature Protocols 2011, 6, 1163-1182.

Cox, "Bar coding objects with DNA," Analyst 2001, 126, 545-547.

Craig et al., "Identification of genetic variants using bar-coded multiplexed sequencing," Nat Methods 2008, 5(10), 887-893.

Cusanovich et al., "Multiplex single-cell profiling of chromatin accessibility by combinatorial cellular indexing," Science 2015, 348(6237), 910-914.

Custom Antibody Services, Precision Antibody, accessed Apr. 16, 2014, 2 pp.

Daines et al., "High-throughput multiplex sequencing to discover copy number variants in *Drosophila*," Genetics 2009, 182(4), 182, 935-941.

Dalerba et al., "Single-cell dissection of transcriptional heterogeneity in human colon tumors," Nat Biotechnol. 2011, 29(12), 1120-1127.

D'Antoni et al., "Rapid quantitative analysis using a single molecule counting approach," Anal Biochem. 2006, 352, 97-109.

Daser et al., "Interrogation of genomes by molecular copy-number counting (MCC)," Nature Methods 2006, 3(6), 447-453.

Day et al., "Immobilization of polynucleotides on magnetic particles," Biochem. J. 1991, 278, 735-740.

De Saizieu et al., "Bacterial transcript imaging by hybridization of total RNA to oligonucleotide arrays," Nature Biotechnology 1988, 16, 45-48.

Decision of Grant dated Aug. 21, 2023 in Japanese Patent Application 2020-561800.

Decision of Refusal dated Aug. 21, 2017 in Japanese Patent Application No. 2014-558975.

Defendant 10X Genomic Inc.'s Notice of Service for Initial Requests for Production and Interrogatories Served to Becton, Dickinson, and Company and Cellular Research, Inc., dated May 31, 2019 in the USDC for the District of Delaware, C.A. 18-1800-RGA, 2 pp.

Defendant 10X Genomics Inc's, Notice of Service of Technical Documents, dated Jul. 8, 2019 in the USDC for the District of Delaware, C.A. 18-1800-RGA, 2 pp.

Defendant 10X Genomic's Motion for Admission Pro Hac Vice of Paul Ehrlich, Azra Hadzimehmedovic and Aaron Nathan, Pursuant to Local Rule 83.5, dated May 1, 2019 in the USDC for the District of Delaware, C.A. 18-1800-RGA, 5 pp.

Defendant 10X Genomic's Notice of Service for Initial Disclosures served to Opposing Counsel, dated Jun. 7, 2019 in the USDC for the District of Delaware, C.A. 18-1800-RGA, 2 pp.

Defendant 10X Genomic's Request for Oral Argument Under D. Del. LR 7.1.4, dated Apr. 18, 2019 in the USDC for the District of Delaware, C.A. 18-1800-RGA 2 pp.

Defendant 10X Genomic's Response Letter to Judge Richard G. Andrews re Request for a Rule 16, dated Apr. 16, 2019 in the USDC for the District of Delaware, C.A. 18-1800-RGA, 2 pp.

Defendant 10X Genomics, Inc.'s [Proposed] Order for Partial Dismissal Pursuant to Federal Rules of Civil Procedure 12(b)(6), dated Jan. 18, 2019 in the USDC District of Delaware, C.A. No. 18-1800-RGA, 1 pp.

Defendant 10X Genomics, Inc.'s Letter to Judge Andrews in Response to Plaintiff's Letter of Supplemental Authority, dated Jul. 11, 2019 in the USDC for the District of Delaware, C.A. 18-1800-RGA, 2 pp.

Defendant 10X Genomics, Inc.'s Motion for Admission Pro Hac Vice Pursuant to Local Rule 83.5, dated Jan. 18, 2019 in the USDC District of Delaware, C.A. No. 18-1800-RGA, 5 pp.

Defendant 10X Genomics, Inc.'s Motion to Dismiss Pursuant to Federal Rule of Civil Procedure 12(b)(6), dated Jan. 18, 2019 in the USDC for the District of Delaware, C.A. 18-1800-RGA, 1 pp.

Defendant 10X Genomics, Inc.'s Motion to Dismiss the First Amended Complaint Pursuant to Federal Rule of Civil Procedure 12(b)(6), dated Mar. 1, 2019 in the USDC for the District of Delaware, C.A. 18-1800-RGA, 1 pp.

Defendant 10X Genomics, Inc.'s Opening Brief in Support of Its Motion to Dismiss Pursuant to Federal Rule of Civil Procedure 12(b)(6), dated Jan. 18, 2019 in the USDC District of Delaware, C.A. No. 1:18-cv-01800-RGA, 25 pp.

Defendant 10X Genomics, Inc.'s Opening Brief in Support of Its Motion to Dismiss Pursuant to Federal Rule of Civil Procedure 12(b)(6), dated Mar. 1, 2019 in the USDC District of Delaware, C.A. No. 18-1800 RGA, 26 pp.

Defendant 10X Genomics, Inc.'s Rule 7.1 Disclosure Statement, dated Jan. 18, 2019 in the USDC District of Delaware, C.A. No. 18-1800-RGA, 1 pp. 1.

Defendant 10X Genomics, Inc's Proposed Order for Dismissal pursuant to Federal Rules of Civil Procedure 12(b)(6), filed Mar. 1, 2019 in the USDC for the District of Delaware, C.A. 18-1800-RGA, 1 pp.

Defendant 10X Genomics's Reply Brief in support of its Motion to Dismiss Pursuant to Federal Rule of Civil Procedure 12(b)(6), dated Apr. 12, 2019 in USDC District of Delaware, C.A. No. 18-1800 RGA, 15 pp.

Delebecque et al. "Designing and using RNA scaffolds to assemble proteins in vivo". Nature protocols, 2012, 7(10), 1797-1807.

Dengl et al., "Engineered hapten-binding antibody derivatives for modulation of pharmacokinetic properties of small molecules and targeted payload delivery," Immunol Rev. 2016, 270, 165-177.

Delley et al., "Combined aptamer and transcriptome sequencing of single cells," bioRxiv 2017, 1-10.

De Simone et al., "Single Cell T Cell Receptor Sequencing: Techniques and Future Challenges," Frontiers in Immunology 2018, 9(1638), 1-7.

Di Carlo et al., "Dynamic single-cell analysis for quantitative biology," Analytical Chemistry 2006, 78(23), 7918-7925.

Dickey and Giangrande. "Oligonucleotide Aptamers: A Next-Generation Technology for the Capture and Detection of Circulating Tumor Cells." Methods, 2016 97:94-103.

Dirks et al., Triggered amplification by hybridization chain reaction., Proc Natl Acad Sci 2014, 101(43), 15275-15278.

Dovgan et al., "Antibody-Oligonucleotide Conjugates as Therapeutic, Imaging, and Detection Agents," Bioconjugate Chem. 2019, 30, 2483-2501.

Dua, et al. "Patents on SELEX and therapeutic aptamers. Recent patents on DNA & gene sequences," 2008, 2( 3), 172-186.

Dube et al., "Mathematical Analysis of Copy Number Variation in a DNA Sample Using Digital PCR on a Nanofluidic Device," PLoS One 2008, 3(8) e2876.

Eberwine et al., "Analysis of gene expression in single live neurons," Proc. Natl. Acad. Sci. 1992, 89, 3010-3014.

Erickson et al., "AbSeq Protocol Using the Nano-Well Cartridge-Based Rhapsody Platform toGenerate Protein and Transcript Expression Data on the Single-Cell Level," STAR Protocols 2020, in 31 pages.

Eulberg, et al. "Development of an automated in vitro selection protocol to obtain RNA-based aptamers: identification of a biostable substance P antagonist," Nucleic acids research, 2005, 33(4), e45. https://doi.org/ 10.1093/nar/gni044.

Evanko et al., "Hybridization chain reaction," Nature Methods 2004, 1(3), 186-187.

Examination Report dated Apr. 10, 2017 in European Patent Application No. 14761937.3.

Examination Report dated Apr. 26, 2019 in European Patent Application No. 16710357.1.

Examination Report dated Aug. 2, 2019 in European Patent Application No. 17202409.3.

Examination Report dated Dec. 12, 2018 in European Patent Application No. 16719706.0.

Examination Report dated Dec. 4, 2019 in European Patent Application No. 16719706.0.

Examination Report dated Feb. 19, 2016 in United Kingdom Patent Application No. GB1511591.8.

(56) References Cited

OTHER PUBLICATIONS

Examination Report dated Feb. 6, 2019 in European Patent Application No. 13754428.4.
Examination Report dated Jan. 2, 2019 in European Patent Application No. 16757986.1.
Examination Report dated Jan. 27, 2016 in United Kingdom Patent Application No. 1408829.8.
Examination Report dated Jan. 3, 2018 in UK Patent Application No. 1609740.4.
Examination Report dated Jul. 12, 2016 in European Patent Application No. 13755319.4.
Examination Report dated Jul. 20, 2018 in Australian Patent Application No. 2014312208.
Examination Report dated May 12, 2020 in Australian Patent Application No. 2018220004.
Examination Report dated Jul. 24, 2019 in European Patent Application No. 16714081.3.
Examination Report dated Jun. 15, 2016 in United Kingdom Patent Application No. GB1511591.8.
Examination Report dated Jun. 18, 2019 in European Patent Application No. 16710551.9.
Examination Report dated Jun. 8, 2016 in United Kingdom Patent Application No. 1408829.8.
Examination Report dated Mar. 16, 2018 in European Patent Application No. 13754428.4.
Examination Report dated Mar. 18, 2019 in Singapore Patent Application No. 11201405274W.
Examination Report dated Oct. 10, 2017 in European Patent Application No. 14761937.3.
Examination Report dated Oct. 11, 2019 in European Patent Application No. 16757986.1.
Examination Report dated Oct. 24, 2017 in Australian Patent Application No. 2013226081.
Examination Report dated Sep. 26, 2018 in European Patent Application No. 16714081.3.
Examination Report dated Sep. 5, 2018 in European Patent Application No. 16710357.1.
Examination Report dated Feb. 19, 2020 in European Patent Application No. 16710551.9.
Examination Report dated Mar. 18, 2020 in European Patent Application No. 17202409.3.
Examination Report dated Jul. 6, 2020 in European Patent Application No. 17781265.8.
Examination Report dated Sep. 21, 2020 in European Patent Application No. 18703156.2.
Examination Report dated Sep. 21, 2023 in Canadian Patent Application 3,034,924.
Examination Report dated Nov. 12, 2020 in European Patent Application No. 18716877.8.
Examination Report dated Dec. 3, 2020 in European Patent Application No. 16719706.0.
Examination Report dated Mar. 25, 2021 in European Patent Application No. 17781265.8.
Examination Report dated Oct. 8, 2021 in European Patent Application No. 18716877.8.
Examination Report dated Nov. 18, 2021 in European Patent Application No. 19724003.9.
Examination Report dated Nov. 24, 2021 in European Patent Application No. 19762517.1.
Examination Report dated Dec. 6, 2021 in European Patent Application No. 18703156.2.
Examination Report dated Dec. 9, 2021 in European Patent Application No. 19723988.2.
Examination Report dated Apr. 7, 2022 in Singapore Patent Application No. 10201806890V.
Examination Report dated Apr. 8, 2022 in Australian Patent Application No. 2018281745.
Examination Report dated Oct. 31, 2023 in European Patent Application 20753616.0.
Examination Report dated Nov. 9, 2023 in European Patent Application 20711394.5.
Examination Report Dated Nov. 24, 2023 in European Patent Application 20209777.0.
Extended European Search Report dated May 6, 2021 in European Patent Application No. 20207621.2.
Extended European Search Report dated May 28, 2021 in European Patent Application No. 20209777.0.
Extended European Search Report Dated Oct. 4, 2023 in European Patent Application No. 23166582.9.
Exhibit A filed Jul. 10, 2019 in the USDC for the District of Delaware, C.A. 18-1800-RGA, 25 pp.
Exhibits 12-32 filed Feb. 8, 2019 in the USDC for the District of Delaware, C.A. 18-1800-RGA, 795 pp.
Exhibits A-D filed Jan. 18, 2019 in the USDC District of Delaware, C.A. No. 1:18-cv-01800-RGA, 47 pp.
Exhibits A-E filed Mar. 1, 2019 in the USDC District of Delaware, C.A. No. 18-1800 RGA, 75 pp.
Extended European Search Report dated Dec. 14, 2015 in European Patent Application No. 13754428.4.
Extended European Search Report dated Feb. 8, 2018 in European Patent Application No. 17202409.3.
Extended European Search Report dated Jul. 17, 2015 in European Patent Application No. 13755319.4.
Extended European Search Report dated Jun. 11, 2018 in European Patent Application No. 16740872.3.
Extended European Search Report dated Mar. 22, 2019 in European Patent Application No. 18195513.9.
Fan et al., "Combinatorial labeling of single cells for gene expression cytometry," Science 2015, 347(6222), 1258366-1258369.
Fan et al., "Microfluidic digital PCR enables rapid prenatal diagnosis of fetal aneuploidy," Am Obstet Gynecol. 2009, 200, 543e1-543e7.
Fan et al., "Non-invasive Prenatal Measurement of the Fetal Genome," Nature 2012, 487(7407), 320-324.
Fan et al., "Parallel Genotyping of Human SNPs Using Generic High-density Oligonucleotide Tag Arrays," Genome Research 2000, 10, 853-860.
Fan, "Molecular counting: from noninvasive prenatal diagnostics to whole-genome haplotyping," Doctoral Dissertation, Stanford University 2010, 1-185.
Fathi,, P. Design and Characterization of SSDNA Aptamer Candidates to Bind Bacteroides Fragilis Toxin Subtypes BFT-1 and BFT-2 (Doctoral dissertation, Johns Hopkins University).2017.
Feldhaus et al., "Oligonucleotide-conjugated beads for transdominant genetic experiments," Nucleic Acids Res. 2000, 28(2), 534-543.
Final Office Action dated Apr. 11, 2016 for U.S. Appl. No. 14/800,526.
Final Office Action dated Aug. 12, 2016 in U.S. Appl. No. 14/381,488.
Final Office Action dated Apr. 22, 2019 in U.S. Appl. No. 15/987,851.
Final Office Action dated Dec. 4, 2019 in U.S. Appl. No. 15/596,364.
Final Office Action dated Feb. 13, 2017 in U.S. Appl. No. 14/381,488.
Final Office Action dated Feb. 19, 2019 in U.S. Appl. No. 14/381,526.
Final Office Action dated Feb. 4, 2020 in U.S. Appl. No. 15/715,028.
Final Office Action dated Jan. 16, 2020 in U.S. Appl. No. 16/012,584.
Final Office Action dated Jan. 25, 2018 in U.S. Appl. No. 14/381,526.
Final Office Action dated Jan. 29, 2020 in U.S. Appl. No. 14/381,488.
Final Office Action dated Jan. 8, 2020 in U.S. Appl. No. 15/459,977.
Final Office Action dated Jul. 20, 2016 for U.S. Appl. No. 14/281,706.
Final Office Action dated Jul. 20, 2018 in U.S. Appl. No. 15/217,886.
Final Office Action dated Jul. 5, 2018 in U.S. Appl. No. 15/004,618.
Final Office Action dated Mar. 1, 2019 in U.S. Appl. No. 16/012,584.
Final Office Action dated May 10, 2018 in U.S. Appl. No. 14/381,488.
Final Office Action dated May 2, 2019 in U.S. Appl. No. 16/012,635.
Final Office Action dated May 3, 2018 in U.S. Appl. No. 15/046,225.
Final Office Action dated May 3, 2019 in U.S. Appl. No. 15/937,713.
Final Office Action dated May 8, 2017 in U.S. Appl. No. 15/224,460.
Final Office Action dated Nov. 16, 2017 in U.S. Appl. No. 14/381,488.
Final Office Action dated Nov. 16, 2018 in U.S. Appl. No. 15/134,967.
Final Office Action dated Oct. 16, 2017 in U.S. Appl. No. 15/409,355.
Final Office Action dated Oct. 2, 2019 in U.S. Appl. No. 15/084,307.
Final Office Action dated Oct. 6, 2015 in U.S. Appl. No. 14/540,018.
Final Office Action dated Sep. 1, 2015 for U.S. Appl. No. 14/540,029.
Final Office Action dated Sep. 18, 2019 in U.S. Appl. No. 15/055,407.

(56) References Cited

OTHER PUBLICATIONS

Final Office Action dated Sep. 24, 2015 for U.S. Appl. No. 14/540,007.
Final Office Action dated Mar. 9, 2020 in U.S. Appl. No. 15/987,851.
Final Office Action dated Apr. 28, 2020 in U.S. Appl. No. 15/134,967.
Final Office Action dated Jun. 5, 2020 in U.S. Appl. No. 15/084,307.
Final Office Action dated Aug. 19, 2020 in U.S. Appl. No. 15/875,816.
Final Office Action dated Sep. 14, 2020 in U.S. Appl. No. 16/789,358.
Final Office Action dated Sep. 22, 2020 in U.S. Appl. No. 16/789,311.
Final Office Action dated Sep. 25, 2020 in U.S. Appl. No. 15/055,407.
Final Office Action dated Dec. 7, 2020 in U.S. Appl. No. 16/012,584.
Final Office Action dated Feb. 11, 2021 in U.S. Appl. No. 15/134,967.
Final Office Action dated Mar. 16, 2021 in U.S. Appl. No. 15/715,028.
Final Office Action dated Mar. 25, 2021 in U.S. Appl. No. 16/374,626.
Final Office Action dated Jun. 15, 2021 in U.S. Appl. No. 15/084,307.
Final Office Action dated Jul. 15, 2021 in U.S. Appl. No. 16/836,750.
Final Office Action dated Aug. 10, 2021 in U.S. Appl. No. 16/012,584.
Final Office Action dated Aug. 27, 2021 in U.S. Appl. No. 15/055,407.
Final Office Action dated Sep. 24, 2021 in U.S. Appl. No. 16/788,743.
Final Office Action dated Oct. 1, 2021 in U.S. Appl. No. 16/677,012.
Final Office Action dated Nov. 2, 2021 in U.S. Appl. No. 16/789,311.
Final Office Action dated Jan. 18, 2022 in U.S. Appl. No. 16/588,405.
Final Office Action dated Feb. 23, 2022 in U.S. Appl. No. 16/707,780.
Final Office Action dated Mar. 15, 2022 in U.S. Appl. No. 16/374,626.
Final Office Action dated Mar. 25, 2022 in U.S. Appl. No. 16/551,620.
Final Office Action dated Apr. 12, 2022 in U.S. Appl. No. 15/084,307.
Final Office Action dated May 26, 2022 in U.S. Appl. No. 16/747,737.
Final Office Action dated Jun. 14, 2022 in U.S. Appl. No. 15/055,407.
Final Office Action dated Aug. 23, 2022 in U.S. Appl. No. 16/012,584.
Final Office Action dated Nov. 15, 2022 in U.S. Appl. No. 16/525,054.
Final Office Action dated Nov. 16, 2022 in U.S. Appl. No. 16/588,405.
Final Office Action dated Jan. 25, 2023 in U.S. Appl. No. 16/789,311.
Final Office Action dated Jan. 26, 2023 in U.S. Appl. No. 16/459,444.
Final Office Action dated Feb. 21, 2023 in U.S. Appl. No. 16/551,620.
Final Office Action dated Apr. 25, 2023 in U.S. Appl. No. 16/525,054.
Final Office Action dated May 15, 2023 in U.S. Appl. No. 16/551,638.
Final Office Action dated May 19, 2023 in U.S. Appl. No. 17/163,177.
Final Office Action dated May 31, 2023 in U.S. Appl. No. 16/934,530.
Final Office Action dated Jun. 8, 2023 in U.S. Appl. No. 17/147,283.
Final Office Action dated Oct. 5, 2023 in U.S. Appl. No. 17/151,050.
Final Office Action dated Oct. 13, 2023 in U.S. Appl. No. 15/055,407.
Final Office Action dated Oct. 23, 2023 in U.S. Appl. No. 16/540,971.
Final Office Action dated Dec. 27, 2023 in U.S. Appl. No. 17/174,249.
Fitzgerald and Grivel, "A Universal Nanoparticle Cell Secretion Capture Assay," Cytometry Part A 2012, 83A(2), 205-211.
First Action Interview Office Action Summary dated Jan. 25, 2019 in U.S. Appl. No. 15/987,851.
First Action Interview Pilot Program Pre-Interview Communication dated Oct. 15, 2018 in U.S. Appl. No. 15/987,851.
Flanigon et al., "Multiplex protein detection with DNA readout via mass spectrometry," N Biotechnol. 2013, 30(2), 153-158.
Forster et al., "A human gut bacterial genome and culture collection for improved metagenomic analyses," Nature Biotechnology 2019, 37, 186-192.
Fox-Walsh et al., "A multiplex RNA-seq strategy to profile poly(A+) RNA: application to analysis of transcription response and 3' end formation," Genomics 2011, 98, 266-721.
Fu et al., "Counting individual DNA molecules by the stochastic attachment of diverse labels," Proc Natl Acad Sci 2011, 108(22), 9026-9031.
Fu et al., Digital Encoding of Cellular mRNAs Enabling Precise and Absolute Gene Expression Measurement by Single-Molecule Counting. Anal Chem. 2014, 86, 2867-2870.
Fu et al., "Molecular indexing enables quantitative targeted RNA sequencing and reveals poor efficiencies in standard library preparation," PNAS 2014, 111(5), 1891-1896.
Gerlach, et al., "Combined quantification of intracellular (phospho-) proteins and transcriptomics from fixed single cells", Scientific Reports, 2019 vol. 9:1469, pp. 1-10.
Gertz et al., "Transposase mediated construction of RNA-seq libraries," Genome Research 2012, 22, 134-141.

Gerry et al., "Universal DNA Microarray Method for Multiplex Detection of Low Abundance Point Mutations," Journal of Molecular Biology 1999, 292, 251-262.
Gillespie, "Exact Stochastic Simulation of Coupled Chemical Reactions," Journal of Physical Chemistry 1977, 81(25), 2340-2361.
Gong et al., "Massively parallel detection of gene expression in single cells using subnanolitre wells," Lab Chip 2010, 10, 2334-2337.
Gong et al., "Simple Method Prepare Oligonucleotide-Conjugated Antibodies and Its Application in Multiplex Protein Detection in Single Cells," Bioconjugate Chem. 2016, 27, 217-225.
Goodridge et al., "Synthesis of Albumin and Malic Enzyme in Wheat-Germ Lysates and *Xenopus laevis* Oocytes Programmed with Chicken-Liver Messenger RNA," Eur. J. Biochem. 1979, 96, 1-8.
Gratton et al., "Cell-permeable peptides improve cellular uptake and therapeutic gene delivery of replication-deficient viruses in cells and in vivo," Nature Medicine 2003, 9(3), 357-362.
Grant et al., "SNP genotyping on a genome-wide amplified DOP-PCR template," Nucleic Acids Res 2002, 30(22), e25, 1-6.
Gu et al., "Complete workflow for detection of low frequency somatic mutations from cell-free DNA using Ion Torrent™ platforms," Conference Poster, AACR 107th Annual Meeting, Apr. 16-20, 2016, 1 p.
Gu et al., "Depletion of abundant sequences by hybridization (DSH): using Cas9 to remove unwantedhigh-abundance species in sequencing libraries and molecular counting applications," Genome Biology 2016, 17(41) 1-13.
Gunderson et al., "Decoding Randomly Ordered DNA Arrays," Genome Research 2004, 14, 870-877.
Gundry et al., "Direct mutation analysis by high-throughput sequencing: from germline to low-abundant, somatic variants," Mutat Res. 2012, 729(1-2), 1-15.
Gundry et al., "Direct, genome-wide assessment of DNA mutations in single cells," Nucleic Acids Research 2011, 40(5), 2032-2040.
Hacia et al., "Determination of ancestral alleles for human single-nucleotide polymorphisms using high-density oligonucleotide arrays," Nature Genetics 1999, 22, 164-167.
Haff, "Improved Quantitative PCR Using Nested Primers," PCR Methods and Applications 1994, 3, 332-337.
Hamady et al., "Error-correcting barcoded primers for pyrosequencing hundreds of samples in multiplex," Nat Methods 2008, 5(3), 235-237.
Han et al., "An approach to multiplexing an immunosorbent assay with antibody-oligonucleotide conjugates," Bioconjug Chem. 2010, 21(12), 2190-2196.
Harbers, "The current status of cDNA cloning," Genomics 2008, 91, 232-242.
Harrington et al., Cross-sectional characterization of HIV-1 env compartmentalization in cerebrospinal fluid over the full disease course, AIDS 2009, 23(8), 907-915.
Hartmann, "Gene expression profiling of single cells on large-scale oligonucleotide arrays", Nucleic Acids Research, (Oct. 2006) vol. 34, No. 21, p. e143, 1-12.
Hashimshony et al., "CEL-Seq: Single-Cell RNA-Seq by Multiplexed Linear Amplification," Cell Rep. 2012, 2(3), 666-673.
Hensel et al., "Simultaneous identification of bacterial virulence genes by negative selection," Science 1995, 269(5222), 400-403.
Hiatt et al., "Parallel, tag-directed assembly of locally derived short sequence reads," Nat Methods 2010, 7(2), 119-122.
Hiatt et al., "Single molecule molecular inversion probes for targeted, high-accuracy detection of low-frequency variation," Genome Res. 2013, 23(5), 843-854.
Hoinka and Przytycka. "AptaPLEX-A Dedicated, Multithreaded Demultiplexer for HT-SE LEX Data." Methods, 2016, 106:82-85.
Holcomb et al., "Abstract 1853: Single-cell multiplexed profiling of protein-level changes induced by EGFR inhibitor gefitinib," Cancer Res 2016, 76(14 Suppl), Abstract 1853.
Hollas et al., "A stochastic approach to count RNA molecules using DNA sequencing methods," Algorithms in Bioinformatics. WABI 2003, Lecture Notes in Computer Science, 2812, 55-62.
How many species of bacteria are there? Wisegeek.org, accessed Jan. 21, 2014, 2 pp.

(56) References Cited

OTHER PUBLICATIONS

Hu et al., "Dissecting Cell-Type Composition and Activity-Dependent Transcriptional State in Mammalian Brains by Massively Parallel Single-Nucleus RNA-Seq," Molecular Cell 2017, 68, 1006-1015.
Hu et al., "Single Cell Multi-Omics Technology: Methodology and Application," Frontiers in Cell and Developmental Biology 2018, 6(28), 1-13.
Hug et al., Measure of the Number of Molecular of a Single mRNA Species in a Complex mRNA Preparation, Journal of Theoretical Biology 2003, 221, 615-624.
Illumina, "Data Processing of Nextera Mate Pair Reads on Illumina Sequencing Platforms", Data Processing Technical Note from 2012.
Illumina, "Estimating Sequencing Coverage" Technical Note: Sequencing from 2014.
Illumina, "Optimizing Cluster Density on Illumina Sequencing Systems", Publication No. 770-2014-031, 2016.
Ingolia et al., Genome-Wide Analysis in Vivo of Translation with Nucleotide Resolution Using Ribosome Profiling, Science 2009, 324(5924), 218-223.
International Preliminary Report on Patentability dated Aug. 15, 2019 in PCT Application No. PCT/US2018/014385.
International Preliminary Report on Patentability dated Mar. 26, 2019 in PCT Application No. PCT/US2017/053331.
International Search Report and Written Opinion dated Aug. 16, 2013 for PCT Application No. PCT/US2013/027891.
International Search Report and Written Opinion dated Sep. 28, 2016 in PCT Application No. PCT/US2016/028694.
International Search Report and Written Opinion dated Aug. 7, 2017 in PCT Application No. PCT/US2017/034576.
International Search Report and Written Opinion dated Aug. 9, 2016 in PCT Application No. PCT/US2016/019971.
International Search Report and Written Opinion dated Dec. 19, 2014 in PCT Application No. PCT/US2014/059542.
International Search Report and Written Opinion dated Dec. 4, 2019 in PCT Application No. PCT/US2019/053868.
International Search Report and Written Opinion dated Dec. 5, 2016 in PCT Application No. PCT/US2016/024783.
International Search Report and Written Opinion dated Feb. 3, 2015 in PCT Application No. PCT/US2014/053301.
International Search Report and Written Opinion dated Jan. 27, 2020 in PCT Application No. PCT/US2019/048179.
International Search Report and Written Opinion dated Jan. 31, 2017 in PCT Application No. PCT/US2016/050694.
International Search Report and Written Opinion dated Jul. 16, 2018 in PCT Application No. PCT/US2018/024602.
International Search Report and Written Opinion dated Jun. 14, 2013 in PCT Application No. PCT/US2013/028103.
International Search Report and Written Opinion dated Jun. 17, 2016 in PCT Application No. PCT/US2016/019962.
International Search Report and Written Opinion dated Jun. 20, 2016 in PCT Application No. PCT/US2016/014612.
International Search Report and Written Opinion dated Jun. 24, 2019 in PCT Application No. PCT/US2019/030175.
International Search Report and Written Opinion dated Jun. 6, 2012 in PCT Application No. PCT/US2011/065291.
International Search Report and Written Opinion dated Jun. 9, 2016 in PCT Application No. PCT/US2016/022712.
International Search Report and Written Opinion dated Mar. 20, 2018 in PCT Application No. PCT/US2017/053331.
International Search Report and Written Opinion dated Mar. 28, 2018 in PCT Application No. PCT/US2018/014385.
International Search Report and Written Opinion dated May 3, 2016 in PCT Application No. PCT/US2016/018354.
International Search Report and Written Opinion dated May 7, 2012 for PCT Application No. PCT/IB2011/003160.
International Search Report and Written Opinion dated Nov. 27, 2019 in PCT Application No. PCT/US2019/046549.
International Search Report and Written Opinion dated Oct. 16, 2019 in PCT Application No. PCT/US2019/030245.
International Search Report and Written Opinion dated Oct. 8, 2019 in PCT Application No. PCT/US2019/043949.
International Search Report and Written Opinion dated Sep. 27, 2016 in PCT Application No. PCT/US2016/034473.
International Search Report and Written Opinion dated Sep. 8, 2017 in PCT Application No. PCT/US2017/030097.
International Search Report and Written Opinion dated Mar. 30, 2020 in PCT Application No. PCT/US2019/060243.
International Search Report and Written Opinion dated Mar. 30, 2020 in PCT Application No. PCT/US2019/065237.
International Search Report and Written Opinion dated May 18, 2020 in PCT Application No. PCT/US2020/014339.
International Search Report and Written Opinion dated Nov. 12, 2020 in PCT Application No. PCT/US2020/042880.
International Search Report and Written Opinion dated Jan. 19, 2021 in PCT Application No. PCT/US2020/059419.
International Search Report and Written Opinion dated Apr. 9, 2021 in PCT Application No. PCT/US2021/013137.
International Search Report and Written Opinion dated Apr. 21, 2021 in PCT Application No. PCT/US2021/015571.
International Search Report and Written Opinion dated May 4, 2021 in PCT Application No. PCT/US2021/013109.
International Search Report and Written Opinion dated May 11, 2021 in PCT Application No. PCT/US2021/013748.
International Search Report and Written Opinion dated Jul. 15, 2021 in PCT Application No. PCT/US2021/019475.
International Search Report and Written Opinion dated Jul. 20, 2021 in PCT Application No. PCT/US2021/015898.
International Search Report and Written Opinion dated Aug. 31, 2021 in PCT Application No. PCT/US2021/035270.
International Search Report and Written Opinion dated Sep. 22, 2021, in PCT Application No. PCT/US2021/013747.
International Search Report and Written Opinion dated Sep. 27, 2021, in PCT Application No. PCT/US2021/017719.
International Search Report and Written Opinion dated Oct. 12, 2021, in PCT Application No. PCT/US2021/041327.
International Search Report and Written Opinion dated Oct. 29, 2021, in PCT Application No. PCT/US2021/032319.
International Search Report and Written Opinion dated Dec. 6, 2021, in PCT Application No. PCT/US2021/046750.
International Search Report and Written Opinion dated Nov. 12, 2021, in PCT Application No. PCT/US2021/044036.
International Search Report and Written Opinion dated Mar. 10, 2022, in PCT Application No. PCT/US2021/060206.
International Search Report and Written Opinion dated Apr. 12, 2022, in PCT Application No. PCT/US2021/059573.
International Search Report and Written Opinion dated Mar. 11, 2022, in PCT Application No. PCT/US2021/060197.
International Search Report and Written Opinion dated Apr. 5, 2022, in PCT Application No. PCT/US2021/062473.
International Search Report and Written Opinion dated Jun. 8, 2022, in PCT Application No. PCT/US2022/021015.
International Search Report and Written Opinion dated Jul. 29, 2022, in PCT Application No. PCT/US2022/029023.
International Search Report and Written Opinion dated Jul. 29, 2022, in PCT Application No. PCT/US2022/029057.
International Search Report and Written Opinion dated Dec. 5, 2022, in PCT Application No. PCT/US2022/075774.
International Search Report and Written Opinion dated Dec. 15, 2022, in PCT Application No. PCT/US2022/075655.
International Search Report and Written Opinion dated Dec. 20, 2022, in PCT Application No. PCT/US2022/075661.
International Search Report and Written Opinion dated Jan. 9, 2023, in PCT Application No. PCT/US2022/076366.
International Search Report and Written Opinion dated Jan. 17, 2023, in PCT Application No. PCT/US2022/076056.
International Search Report and Written Opinion dated Feb. 13, 2023, in PCT Application No. PCT/US2022/075656.
International Search Report and Written Opinion dated Jun. 5, 2023, in PCT Application No. PCT/US2023/061980.
International Search Report and Written Opinion dated Jun. 23, 2023 in PCT Application No. PCT/US2023/062070.

(56) References Cited

OTHER PUBLICATIONS

International Search Report and Written Opinion dated Jan. 12, 2024 in PCT Application PCT/US2023/078302.
International Search Report and Written Opinion dated Feb. 27, 2024 in PCT Application PCT/US2023/036545.
Invitation to Pay Fees dated May 25, 2021 in PCT Application No. PCT/US2021/01598.
Invitation to Pay Additional Search Fees dated Sep. 8, 2021 in PCT Application No. PCT/US2021/032319.
Invitation to Provide Informal Clarification dated Jun. 9, 2021 in PCT Application No. PCT/US2021/019475.
Invitation to Pay Fees dated Mar. 16, 2016 in PCT Application No. PCT/US2016/019971.
Invitation to Pay Fees dated May 16, 2018 in PCT Application No. PCT/US2018/024602.
Invitation to Pay Fees dated Nov. 26, 2019 in PCT Application No. PCT/US2019/048179.
Invitation to Pay Fees dated May 7, 2020 in PCT Application No. PCT/US2020/017890.
Invitation to Respond to Written Opinion dated May 26, 2017 in Singapore Patent Application No. 11201405274W.
Invitrogen, "The attraction is simply magnetisk, Dynabeads® Streptavidin products and applications" Invitrogen, 2010, 1-8.
Islam et al., "Characterization of the single-cell transcriptional landscape by highly multiplex RNA-seq," Genome Research 2011, 21, 1160-1167.
Islam et al., "Highly multiplexed and strand specific single-cell RNA 5' end sequencing," Nature Protocols 2012, 7(5), 813-828.
Islam et al., "Quantitative single-cell RNA-seq with unique molecular identifiers," Nature Methods 2014, 11(2), 163-168.
Jabara et al., "Accurate sampling and deep sequencing of the HIV-1 protease gene using a Primer ID," PNAS 2011, 108(50), 20166-20171.
Jabara, "Capturing the cloud: High throughput sequencing of multiple individual genomes from aretroviral population," Biology Lunch Bunch Series, Training Initiatives in Biomedical & Biological Sciences of the University of North Carolina at Chapel Hill 2010.
Jacobsen et al., "33rd Annual Meeting & Pre-Conference Programs of the Society for Immunotherapy of Cancer," Journal for Immunotherapy of Cancer 2018, 6(S1), 7-11.
Janeway et al., "Structural variation in immunoglobulin constant regions," Immunology: The Immune System in Health and Disease 1999, 101-103.
Jason J. Rawnsley of Richards, Layton and Finger, P.A., Entry of Appearance dated Jan. 18, 2019 in the USDC District of Delaware, C.A. No. 18-1800-RGA, 1 pp.
Jiang et al., "Synthetic spike-in standards for RNA-seq experiments," Genome Res. 2011, 21, 1543-1551.
Joint Stipulation and Order to Extend Time to Respond to Plaintiff's First Amended Complaint, dated Feb. 21, 2019 in the USDC for the District of Delaware, C.A. 18-1800-RGA, 2 pp.
Joint Stipulation and Order to Extended Time to Submit Agreed Document Production Protocol, filed Jun. 28, 2019 in the USDC for the District of Delaware, C.A. 18-1800 (RGA), 1 pp.
Joint Stipulation and Order to Request Extended Time to File Opposition to Defendant's Motion to Dismiss dated, Mar. 8, 2019 in the USDC District of Delaware, C.A. No. 18-1800 RGA, 2 pp.
Joint Stipulation and Order to Request Extended Time to Submit a proposed Protective Order, dated Jun. 7, 2019 in the USDC for the District of Delaware, C.A. 18-1800-RGA, 1 pp.
Joint Stipulation and Order to Request Extended Time to Submit Agreed Document Production Protocol, dated Jul. 11, 2019 in the USDC for the District of Delaware, C.A. 18-1800 (RGA), 1 pp.
Junker et al., "Single-Cell Transcriptomics Enters the Age of Mass Production," Molecular Cell 2015, 58, 563-564.
Kanagawa, "Bias and artifacts in multi-template polymerase chain reactions (PCR)," Journal of Bioscience and Bioengineering 2003, 96(4), 317-323.
Kang et al., "Application of multi-omics in single cells," Ann Biotechnol. 2018, 2(1007), 1-8.
Kang et al., "Targeted sequencing with enrichment PCR: a novel diagnostic method for the detection of EGFR mutations," Oncotarget 2015, 6(15), 13742-13749.
Karrer et al., "In situ isolation of mRNA from individual plant cells: creation of cell-specific cDNA libraries," Proc. Natl. Acad. Sci. USA 1995, 92, 3814-3818.
Kausch et al., "Organelle Isolation by Magnetic Immunoabsorption," BioTechniques 1999, 26(2), 336-343.
Kebschull et al., "Sources of PCR-induced distortions in high-throughput sequencing data sets," Nucleic Acids Research 2015, 1-15.
Keys et al., Primer ID Informs Next-Generation Sequencing Platforms and Reveals Preexisting DrugResistance Mutations in the HIV-1 Reverse Transcriptase Coding Domain, AIDS Research and Human Retroviruses 2015, 31(6), 658-668.
Kim et al., Polony Multiplex Analysis of Gene Expression (PMAGE) in Mouse Hypertrophic Cardiomyopathy, Science 2007, 316(5830), 1481-1484.
Kinde et al., "Detection and quantification of rare mutations with massively parallel sequencing," Proc. Natl Acad Sci 2011, 108(23), 9530-0535.
Kirsebom et al., "Stimuli-Responsive Polymers in the 21st Century: Elaborated Architecture to Achieve High Sensitivity, Fast Response, and Robust Behavior," Journal of Polymer Science: Part B: Polymer Physics 2011, 49, 173-178.
Kivioja et al., "Counting absolute numbers of molecules using unique molecular identifiers," Nature Proceedings 2011, 1-18.
Klein et al., Droplet Barcoding for Single-Cell Transcriptomics Applied to Embryonic Stem Cells, Cell 2015, 161, 1187-1201.
Ko et al., "RNA-conjugated template-switching RT-PCR method for generating an *Escherichia coli* cDNA library for small RNAs," Journal of Microbiological Methods 2006, 64, 297-304.
Ko, "An 'equalized cDNA library' by the reassociation of short double-stranded cDNAs," Nucleic Acids Res. 1990, 18(19), 5705-5711.
Koboldt et al., VarScan: variant detection in massively parallel sequencing of individual and pooled samples, Bioinformatics 2009, 25(17), 2283-2285.
Kolodziejczyk et al., The Technology and Biology of Single-Cell RNA Sequencing, Molecular Cell 2015, 58, 610-620.
Konig et al., iCLIP reveals the function of hnRNAP particles in splicing at individual nucleotide resolution, Nature Structural & Molecular Biology 2010, 17(7), 909-916.
Kotake et al., "A simple nested RT-PCR method for quantitation of the relative amounts of multiple cytokine mRNAs in small tissue samples," Journal of Immunological Methods 1996, 199, 193-203.
Kozarewa & Turner, "96-Plex Molecular Barcoding for the Illumina Genome Analyzer," High-Throughput Next Generation Sequencing. Methods in Molecular Biology (Methods and Applications) 2011, 733, 24 pp. DOI: 10.1007/978-1-61779-089-8_20.
Kozlov et al., "A high-complexity, multiplexed solution-phase assay for profiling protease activity on microarrays," Comb Chem High Throughput Screen 2008, 11(1), 24-35.
Ku, et al. "Nucleic Acid Aptamers: An Emerging Tool for Biotechnology and Biomedical Sensing." Sensors, 2015, 15, 16281-16313.
Kurimoto et al., "An improved single-cell cDNA amplification method for efficient high-density oligonucleotide microarray analysis," Nucleic Acids Res. 2006, 34(5), e42, 1-17.
Kurimoto et al., "Global single-cell cDNA amplification to provide a template for representative high-density oligonucleotide microarray analysis," Nature Protocols 2007, 2(3), 739-752.
Lake et al., "Integrative single-cell analysis of transcriptional and epigenetic states in the human adult brain," Nature Biotechnology 2018, 36(1), 70-80.
Lan et al., "Droplet barcoding for massively parallel single-molecule deep sequencing," Nature Communications 2016, 7(11784), in 10 pages.
Lamble et al., "Improved workflows for high throughput library preparation using the transposome-based nextera system," BMC Biotechnology 2013, 13, 104, 1-10.

(56) References Cited

OTHER PUBLICATIONS

Larson et al., "A single molecule view of gene expression," Trends Cell Biol. 2009, 19(11), 630-637.
Lass-Napiorkowska et al., "Detection methodology based on target molecule-induced sequence-specific binding to a single-stranded oligonucleotide," Anal Chem. 2012, 84(7), 3382-3389.
Lebl et al. "A High-Complexity, Multiplexed Solution-Phase Assay for Profiling Protease Activity oin Microarrays", Combinatorial Chemistry and High Throughput Screening, 2008, 11(1), 24-35.
Leamon et al., A massively parallel PicoTiterPlate based platform for discrete picoliter-scale polymerase chain reactions, Electrophoresis 2003, 24, 3769-3777.
Lee et al., "Highly Multiplexed Subcellular RNA Sequencing in Situ," Science 2014, 343, 1360-1363.
Lee et al., "Large-scale arrays of picolitre chambers for single-cell analysis of large cell populations," Lab Chip 2010, 10, 2952-2958.
Lee et al., "Universal process-inert encoding architecture for polymer microparticles," Nature Materials 2014, 13(5), 524-529.
Letter regarding the opposition procedure dated Jul. 22, 2015 for European Patent Application No. 11810645.9.
Letter to Judge Andrews regarding Agreement on Proposed Scheduling Order, dated May 7, 2019 in the USDC for the District of Delaware, C.A. 18-1800-RGA, 1 pp.
Letter to Judge Andrews regarding Notice of Supplemental Authority, dated Jul. 10, 2019 in the USDC for the District of Delaware, C.A. 18-1800(RGA), 2pp.
Letter to Judge Richard G. Andrews Requesting a Rule 16 Conference, dated Apr. 15, 2019 in the USDC for the District of Delaware, C.A. 18-1800 (RGA), 1 pp.
Lin et al., "Self-Assembled Combinatorial Encoding Nanoarrays for Multiplexed Biosensin," Nano Lett. 2007, 7 (2), 507-512.
Liu et al., "Single-cell transcriptome sequencing: recent advances and remaining challenges," F1000Research 2016, 5(F1000 Faculty Rev)(182), 1-9.
Livingstone, "rRNA depletion, poly(A) enrichment, or exonuclease treatment?" Tebu-Bio Blog 2015,. 5 pgs.
Lizardi et al., "Mutation detection and single-molecule counting using isothermal rolling-circle amplification," Nat Genet. 1998, 19, 225-232.
Lockhart et al., "Expression monitoring by hybridization to high-density oligonucleotide arrays," Nature Biotechnology 1996, 14, 1675-1680.
Lovatt et al., "Transcriptome in vivo analysis (TIVA) of spatially defined single cells in live tissue," Nat Methods 2014, 11(2), 190-196.
Loy et al., "A rapid library preparation method with custom assay designs for detection of variants at 0.1% allelic frequency in liquid biopsy samples," Oct. 2, 2018, 1 p.
Lucito et al., "Representational Oligonucleotide Microarray Analysis: A High-Resolution Method to Detect Genome Copy Number Variation," Genome Research 2003, 13, 2291-2305.
Lundberg et al., "Practical innovations for high-throughput amplicon sequencing," Nature Methods 2013, 10(10), 999-1007.
Lundberg et al., "Supplementary Information for: Practical innovations for high-throughput amplicon sequencing," Nature Methods 2013, 1-24.
Lutz et al., "Isolation and analysis of high quality nuclear DNA with reduced organellar DNA for plant genome sequencing and resequencing," BMC Biotechnology 2011, 11(54), in 9 pages.
Maamar et al., "Noise in Gene Expression Determines Cell Fate in Bacillus subtilis," Science 2007, 317, 526-529.
Macaulay et al., "G&T-seq: parallel sequencing of single-cell genomes and transcriptomes," Nature Methods 2015, 1-7.
Macaulay et al., "Single Cell Genomics: Advances and Future Perspectives," PLoS Genetics 2014, 10(1), 1-9.
Macosko et al., "Highly parallel genome-wide expression profiling of individual cells using nanoliter droplets," Cell 2015, 161, 1202-1214.
Maeda et al., "Development of a DNA barcode tagging method for monitoring dynamic changes in gene expression by using an ultra high-throughput sequencer," BioTechniques 2008, 45(1), 95-97.
Mair et al., "A Targeted Multi-omic Analysis Approach Measures Protein Expression and Low-Abundance Transcripts on the Single-Cell Level", Cell Reports 2020, 31(1), 107499, in 20 pages.
Mairal et al. "Aptamers: Molecular Tools for Analytical Applications." Analytical and bioanalytical chemistry 2008,390: 989-1007.
Mayer et al., "Obtaining deeper insights into microbiome diversity using a simple method to block host and nontargets in amplicon sequencing," Molecular Ecology Resources 2021, 21(6), 1952-1965.
Makrigiorgos et al., "A PCR-Based amplification method retaining quantities difference between two complex genomes," Nature Biotech 2002, 20(9), 936-939.
Marcus et al., 2006, "Microfluidic single-cell mRNA isolation and analysis," Anal Chem. 2006, 78, 3084-3089.
Mardis, "Next-generation DNA sequencing methods", Annu. Rev. Genomics Hum. Genet. 2008, 9, 387-402.
Marguerat et al., "Next-generation sequencing: applications beyond genomes," Biochem. Soc. Trans. 2008, 36(5), 1091-1096.
Marguiles et al., Genome sequencing in microfabricated high-density picolitre reactors, Nature 2005, 437, 376-380.
Martinez et al., "A microfluidic approach to encapsulate living cells in uniform alginate hydrogel microparticles," Macromol. Biosci 2012, 12, 946-951.
Massachusetts General Hospital, Overview of Illumina Chemistry, http://nextgen.mgh.harvard.edu/IlluminaChemistry.html, downloaded Jan. 28, 2020, 2 pp.
McCloskey et al., "Encoding PCR products with batch-stamps and barcodes," Biochem Genet. 2007, 45(11-12), 761-767.
Medvedev et al., "Detecting copy number variation with mated short reads," Genome Res. 2010, 20, 1613-1622.
Mei et al., "Identification of recurrent regions of Copy-Number Variants across multiple individuals," BMC Bioinformatics 2010, 11, 147, 1-14.
Merriam-Webster, definition of associate: http://www.merriam-webster.com/dictionary/associate, accessed Apr. 5, 2016.
Meyer et al., "Parallel tagged sequencing on the 454 platform," Nature Protocols 2008, 3(2), 267-278.
Miller et al., Directed evolution by in vitro compartmentalization, Nature Methods 2006, 3(7), 561-570.
Miner et al., "Molecular barcodes detect redundancy and contamination in hairpin-bisulfite PCR," Nucleic Acids Research 2004, 32(17), e135, 1-4.
Minnoye et al., "Chromatin accessibility profiling methods," Nature Reviews Method Primers 2021, 1-24.
Monneron, "One-step Isolation and Characterization of Nuclear Membranes, 1974 Electron Microscopy and Composition of Biological Membranes and Envelops," The Royal Publishing Society 1974, 268, 101-108.
Mortazavi et al., "Mapping and quantifying mammalian transcriptomes by RNA-Seq," Nat. Methods 2008, 5(7), 621-628.
Motion and Order for Admission Pro Hac Vice Pursuant to Local Rule 83.5, dated Jan. 24, 2019 in the USDC District of Delaware, C.A. No. 18-1800-RGA, 7 pp.
Nadai et al., Protocol for nearly full-length sequencing of HIV-1 RNA from plasma, PLoS One 2008, 3(1), e1420, 1-6.
Nagai et al., "Development of a microchamber array for picoleter PCR," Anal. Chem. 2001, 73, 1043-1047.
Navin et al., "The first five years of single-cell cancer genomics and beyond," Genome Research 2015, 25, 1499-1507.
Newell et al., Cytometry by time-of-flight shows combinatorial cytokine expression and virus-specific cell niches within a continuum of CD8+ T cell phenotypes. Immunity 2012, 36(1), 142-152.
Non-Final Office Action dated Apr. 11, 2016 in U.S. Appl. No. 14/472,363.
Non-Final Office Action dated Apr. 6, 2018 in U.S. Appl. No. 15/603,239.
Non-Final Office Action dated Aug. 17, 2016 for U.S. Appl. No. 14/800,526.
Non-Final Office Action dated Aug. 20, 2019 in U.S. Appl. No. 15/715,028.

(56) References Cited

OTHER PUBLICATIONS

Non-Final Office Action dated Dec. 3, 2015 for U.S. Appl. No. 14/281,706.
Non-Final Office Action dated Dec. 31, 2015 for U.S. Appl. No. 14/800,526.
Non-Final Office Action dated Feb. 18, 2015 for U.S. Appl. No. 14/540,007.
Non-Final Office Action dated Feb. 19, 2019 in U.S. Appl. No. 14/381,526.
Non-Final Office Action dated Feb. 26, 2015 for U.S. Appl. No. 14/540,029.
Non-Final Office Action dated Feb. 5, 2020 in U.S. Appl. No. 15/875,816.
Non-Final Office Action dated Jan. 12, 2018 in U.S. Appl. No. 15/217,886.
Non-Final Office Action dated Jan. 14, 2019 in U.S. Appl. No. 16/219,553.
Non-Final Office Action dated Jan. 17, 2020 in U.S. Appl. No. 15/084,307.
Non-Final Office Action dated Jan. 19, 2017 in U.S. Appl. No. 15/055,445.
Non-Final Office Action dated Jan. 7, 2019 in U.S. Appl. No. 15/055,407.
Non-Final Office Action dated Jan. 9, 2018 in U.S. Appl. No. 15/217,896.
Non-Final Office Action dated Jul. 25, 2018 in U.S. Appl. No. 15/108,268.
Non-Final Office Action dated Jul. 28, 2017 in U.S. Appl. No. 14/975,441.
Non-Final Office Action dated Jul. 9, 2019 in U.S. Appl. No. 15/596,364.
Non-Final Office Action dated Jun. 17, 2019 in U.S. Appl. No. 14/381,488.
Non-Final Office Action dated Jun. 2, 2017 in U.S. Appl. No. 14/381,526.
Non-Final Office Action dated Jun. 7, 2017 in U.S. Appl. No. 14/381,488.
Non-Final Office Action dated Mar. 19, 2015 in U.S. Appl. No. 14/540,018.
Non-Final Office Action dated Mar. 19, 2019 in U.S. Appl. No. 15/046,225.
Non-Final Office Action dated Mar. 24, 2017 in U.S. Appl. No. 15/409,355.
Non-Final Office Action dated Mar. 8, 2018 in U.S. Appl. No. 15/608,780.
Non-Final Office Action dated May 10, 2016 in U.S. Appl. No. 14/381,488.
Non-Final Office Action dated May 13, 2016 in U.S. Appl. No. 14/508,911.
Non-Final Office Action dated May 15, 2019 in U.S. Appl. No. 15/084,307.
Non-Final Office Action dated May 23, 2019 in U.S. Appl. No. 15/459,977.
Non-Final Office Action dated May 7, 2015 for U.S. Appl. No. 13/327,526.
Non-Final Office Action dated Nov. 1, 2017 in U.S. Appl. No. 15/667,125.
Non-Final Office Action dated Nov. 26, 2018 in U.S. Appl. No. 15/937,713.
Non-Final Office Action dated Nov. 29, 2019 in U.S. Appl. No. 15/937,713.
Non-Final Office Action dated Nov. 5, 2018 in U.S. Appl. No. 16/038,790.
Non-Final Office Action dated Nov. 9, 2017 in U.S. Appl. No. 15/004,618.
Non-Final Office Action dated Oct. 11, 2016 in U.S. Appl. No. 15/224,460.
Non-Final Office Action dated Oct. 25, 2018 in U.S. Appl. No. 16/012,584.
Non-Final Office Action dated Oct. 3, 2013 in U.S. Appl. No. 12/969,581.
Non-Final Office Action dated Oct. 4, 2018 in U.S. Appl. No. 15/260,106.
Non-Final Office Action dated Sep. 18, 2019 in U.S. Appl. No. 16/194,819.
Non-Final Office Action dated Sep. 26, 2016 in U.S. Appl. No. 15/167,807.
Non-Final Office Action dated Sep. 8, 2017 in U.S. Appl. No. 15/046,225.
Non-Final Office Action dated Sep. 8, 2017 in U.S. Appl. No. 15/134,967.
Non-Final Office Action dated Mar. 17, 2020 in U.S. Appl. No. 15/055,407.
Non-Final Office Action dated Mar. 12, 2020 in U.S. Appl. No. 16/789,358.
Non-Final Office Action dated Mar. 26, 2020 in U.S. Appl. No. 16/789,311.
Non-Final Office Action dated Mar. 26, 2020 in U.S. Appl. No. 16/012,635.
Non-Final Office Action dated Jun. 8, 2020 in U.S. Appl. No. 15/715,028.
Non-Final Office Action dated Aug. 4, 2020 in U.S. Appl. No. 15/459,977.
Non-Final Office Action dated Aug. 19, 2020 in U.S. Appl. No. 16/374,626.
Non-Final Office Action dated Aug. 25, 2020 in U.S. Appl. No. 14/381,488.
Non-Final Office Action dated Dec. 4, 2020 in U.S. Appl. No. 16/677,012.
Non-Final Office Action dated Dec. 9, 2020 in U.S. Appl. No. 16/788,743.
Non-Final Office Action dated Jan. 19, 2021 in U.S. Appl. No. 16/836,750.
Non-Final Office Action dated Feb. 2, 2021 in U.S. Appl. No. 16/535,080.
Non-Final Office Action dated Feb. 25, 2021 in U.S. Appl. No. 15/055,407.
Non-Final Office Action dated Feb. 25, 2021 in U.S. Appl. No. 15/084,307.
Non-Final Office Action dated Mar. 29, 2021 in U.S. Appl. No. 16/789,358.
Non-Final Office Action dated Apr. 14, 2021 in U.S. Appl. No. 16/789,311.
Non-Final Office Action dated Apr. 20, 2021 in U.S. Appl. No. 15/875,816.
Non-Final Office Action dated May 18, 2021 in U.S. Appl. No. 16/535,080.
Non-Final Office Action dated Jun. 9, 2021 in U.S. Appl. No. 16/588,405.
Non-Final Office Action dated Aug. 17, 2021 in U.S. Appl. No. 16/551,620.
Non-Final Office Action dated Aug. 19, 2021 in U.S. Appl. No. 16/781,814.
Non-Final Office Action dated Aug. 31, 2021 in U.S. Appl. No. 15/715,028.
Non-Final Office Action dated Sep. 1, 2021 in U.S. Appl. No. 16/789,358.
Non-Final Office Action dated Sep. 14, 2021 in U.S. Appl. No. 16/707,780.
Non-Final Office Action dated Sep. 28, 2021 in U.S. Appl. No. 16/400,885.
Non-Final Office Action dated Sep. 30, 2021 in U.S. Appl. No. 16/374,626.
Non-Final Office Action dated Oct. 1, 2021 in U.S. Appl. No. 16/677,012.
Non-Final Office Action dated Oct. 8, 2021 in U.S. Appl. No. 16/400,866.
Non-Final Office Action dated Dec. 15, 2021 in U.S. Appl. No. 15/875,816.
Non-Final Office Action dated Dec. 21, 2021 in U.S. Appl. No. 15/055,407.

(56) References Cited

OTHER PUBLICATIONS

Non-Final Office Action dated Jan. 6, 2022 in U.S. Appl. No. 15/084,307.
Non-Final Office Action dated Feb. 3, 2022 in U.S. Appl. No. 16/747,737.
Non-Final Office Action dated Feb. 9, 2022 in U.S. Appl. No. 16/525,054.
Non-Final Office Action dated Apr. 5, 2022 in U.S. Appl. No. 16/400,885.
Non-Final Office Action dated Apr. 8, 2022 in U.S. Appl. No. 16/232,287.
Non-Final Office Action dated May 3, 2022 in U.S. Appl. No. 16/012,584.
Non-Final Office Action dated May 11, 2022 in U.S. Appl. No. 16/588,405.
Non-Final Office Action dated May 19, 2022 in U.S. Appl. No. 16/459,444.
Non-Final Office Action dated Jul. 7, 2022 in U.S. Appl. No. 16/788,743.
Non-Final Office Action dated Jul. 7, 2022 in U.S. Appl. No. 16/677,012.
Non-Final Office Action dated Jul. 18, 2022 in U.S. Appl. No. 16/551,620.
Non-Final Office Action dated Jul. 27, 2022 in U.S. Appl. No. 16/747,737.
Non-Final Office Action dated Oct. 13, 2022 in U.S. Appl. No. 17/147,272.
Non-Final Office Action dated Nov. 17, 2022 in U.S. Appl. No. 16/551,638.
Non-Final Office Action dated Dec. 8, 2022 in U.S. Appl. No. 16/934,530.
Non-Final Office Action dated Dec. 21, 2022 in U.S. Appl. No. 15/055,407.
Non-Final Office Action dated Jan. 10, 2023 in U.S. Appl. No. 17/163,177.
Non-Final Office Action dated Jan. 19, 2023 in U.S. Appl. No. 17/091,639.
Non-Final Office Action dated Jan. 23, 2023 in U.S. Appl. No. 17/183,840.
Non-Final Office Action dated Jan. 24, 2023 in U.S. Appl. No. 17/157,872.
Non-Final Office Action dated Feb. 10, 2023 in U.S. Appl. No. 17/390,640.
Non-Final Office Action dated Feb. 23, 2023 in U.S. Appl. No. 17/408,374.
Non-Final Office Action dated Mar. 13, 2023 in U.S. Appl. No. 17/151,050.
Non-Final Office Action dated Apr. 26, 2023 in U.S. Appl. No. 16/540,971.
Non-Final Office Action dated Apr. 26, 2023 in U.S. Appl. No. 16/374,626.
Non-Final Office Action dated Jun. 14, 2023 In U.S. Appl. No. 17/174,249.
Non-Final Office Action dated Jun. 30, 2023 In U.S. Appl. No. 17/684,289.
Non-Final Office Action dated Jul. 27, 2023 in U.S. Appl. No. 17/373,519.
Non-Final Office Action dated Sep. 21, 2023 in Canadian Patent Application No. 3,034,924.
Non-Final Office Action dated Sep. 28, 2023 in U.S. Appl. No. 16/789,311.
Non-Final Office Action Dated Sep. 28, 2023 in U.S. Appl. No. 17/184,405.
Non-Final Office Action Dated Oct. 5, 2023 in U.S. Appl. No. 16/848,241.
Non-Final Office Action Dated Nov. 7, 2023 in U.S. Appl. No. 17/528,104.
Non-Final Office Action Dated Dec. 28, 2023 in U.S. Appl. No. 17/157,872.
Non-Final Office Action Dated Jan. 2, 2024 in U.S. Appl. No. 17/373,653.
Non-Final Office Action Dated Jan. 19, 2024 in U.S. Appl. No. 17/336,055.
Notice of Allowability dated Jun. 19, 2014 for U.S. Appl. No. 12/969,581.
Notice of Allowance dated Aug. 22, 2014 for U.S. Appl. No. 12/969,581.
Notice of Allowance dated Dec. 15, 2015 for U.S. Appl. No. 14/540,007.
Notice of Allowance dated Dec. 21, 2015 in U.S. Appl. No. 14/540,018.
Notice of Allowance dated Dec. 27, 2019 in U.S. Appl. No. 15/260,106.
Notice of Allowance dated Jan. 21, 2016 for U.S. Appl. No. 13/327,526.
Notice of Allowance dated Jan. 9, 2019 in U.S. Appl. No. 15/603,239.
Notice of Allowance dated Mar. 21, 2014 for U.S. Appl. No. 12/969,581.
Notice of Allowance dated Mar. 21, 2019 in U.S. Appl. No. 15/993,468.
Notice of Allowance dated May 28, 2019 in U.S. Appl. No. 16/219,553.
Notice of Allowance dated Mar. 20, 2019 in U.S. Appl. No. 16/219,553.
Notice of Allowance dated Nov. 11, 2019 in Japanese Patent Application No. 2017-245295.
Notice of Allowance dated Nov. 29, 2019 in U.S. Appl. No. 16/012,635.
Notice of Allowance dated Sep. 24, 2019 in U.S. Appl. No. 15/217,886.
Notice of Allowance dated Mar. 5, 2020 in U.S. Appl. No. 15/217,886.
Notice of Allowance dated Mar. 27, 2020 in U.S. Appl. No. 15/596,364.
Notice of Allowance dated Mar. 30, 2020 in U.S. Appl. No. 15/937,713.
Notice of Allowance dated Apr. 15, 2020 in U.S. Appl. No. 16/012,635.
Notice of Allowance dated Sep. 23, 2020 in Korean Patent Application No. 10-2016-7008144.
Notice of Allowance dated Oct. 29, 2020 in U.S. Appl. No. 15/987,851.
Notice of Allowance dated Jan. 13, 2021 in U.S. Appl. No. 14/381,488.
Notice of Allowance dated Jan. 13, 2021 in U.S. Appl. No. 15/459,977.
Notice of Allowance dated Apr. 26, 2021 in Japanese Patent Application No. 2019-014564.
Notice of Allowance dated Aug. 16, 2021 in Japanese Patent Application No. 2018-512152.
Notice of Allowance dated Nov. 16, 2021 in U.S. Appl. No. 16/836,750.
Notice of Allowance dated Jan. 24, 2022 in Korean U.S. Appl. No. 16/836,750.
Notice of Allowance dated Feb. 9, 2022 in U.S. Appl. No. 16/781,814.
Notice of Allowance dated Feb. 11, 2022 in Chinese Patent Application No. 201680007351.2.
Notice of Allowance dated Feb. 16, 2022 in U.S. Appl. No. 15/875,816.
Notice of Allowance dated Feb. 21, 2022 in Korean Patent Application No. 10-2020-7033213.
Notice of Allowance dated Apr. 11, 2022 in U.S. Appl. No. 15/134,967.
Notice of Allowance dated Apr. 25, 2022 in Korean Patent Application No. 10-2018-7008560.
Notice of Allowance dated Apr. 26, 2022 in Chinese Patent Application No. 201780058799.1.
Notice of Allowance dated Apr. 27, 2022 in U.S. Appl. No. 16/400,886.
Notice of Allowance dated May 9, 2022 in Australian Patent Application No. 2018281745.
Notice of Allowance dated May 15, 2022 in Japanese Patent Application No. 2019-540515.
Notice of Allowance dated May 23, 2022 in U.S. Appl. No. 15/715,028.

(56) References Cited

OTHER PUBLICATIONS

Notice of Allowance dated May 26, 2022 in Korean Patent Application No. 10-2019-7038794.
Notice of Allowance dated Jun. 6, 2022 in U.S. Appl. No. 16/789,358.
Notice of Allowance dated Jul. 20, 2022 in U.S. Appl. No. 16/707,780.
Notice of Allowance dated Aug. 9, 2022 in U.S. Appl. No. 16/232,287.
Notice of Allowance dated Sep. 26, 2022, 2022 in U.S. Appl. No. 16/232,287.
Notice of Allowance dated Oct. 17, 2022, 2022 in U.S. Appl. No. 16/400,885.
Notice of Allowance dated Oct. 20, 2022 in Australian Patent Application No. 2019204928.
Notice of Allowance dated Oct. 21, 2022 in European Patent Application No. 19762517.1.
Notice of Allowance dated Oct. 24, 2022 in European Patent Application No. 20708266.0.
Notice of Allowance dated Oct. 25, 2022 in European Patent Application No. 19724003.9.
Notice of Allowance dated Nov. 7, 2022 in U.S. Appl. No. 16/012,584.
Notice of Allowance dated Jan. 10, 2023 in U.S. Appl. No. 16/588,405.
Notice of Allowance dated Jan. 19, 2023 in Korean Patent Application No. 10-2022-7004715.
Notice of Allowance dated Jan. 31, 2023 in U.S. Appl. No. 16/747,737.
Notice of Allowance dated Feb. 1, 2023 in U.S. Appl. No. 17/147,272.
Notice of Allowance dated Feb. 21, 2023 in Korean Patent Application No. 10-2022-7017261.
Notice of Allowance dated Mar. 1, 2023 in U.S. Appl. No. 17/192,814.
Notice of Allowance dated Mar. 10, 2023 in European Patent Application No. 19762517.1.
Notice of Allowance dated Mar. 10, 2023 in European Patent Application No. 20708266.0.
Notice of Allowance dated Mar. 10, 2023 in European Patent Application No. 19724003.9.
Notice of Allowance dated Mar. 13, 2023 in European Patent Application No. 17781265.8.
Notice of Allowance dated Apr. 4, 2023 in Australian Patent Application No. 2017331459.
Notice of Allowance dated Jun. 8, 2023 in U.S. Appl. No. 16/459,444.
Notice of Allowance dated Aug. 23, 2023 in Canadian Patent Application No. 2,865,575.
Notice of Allowance dated Aug. 25, 2023 in European Patent Application No. 22 200 785.8.
Notice of Allowance dated Aug. 28, 2023 in U.S. Appl. No. 16/374,626.
Notice of Allowance dated Sep. 14, 2023 in Canada Application No. 2982467.
Notice of Allowance dated Sep. 29, 2023 in European Application No. 22165594.7.
Notice of Allowance dated Oct. 2, 2023 in European Application 21735067.8.
Notice of Allowance dated Oct. 25, 2023 in European Application No. 20816802.1.
Notice of Opposition dated Jul. 9, 2015 for European Patent Application No. 11810645.9.
Notice of Reason for Refusal dated Nov. 21, 2019 in Korean Patent Application No. 10-2016-7008144.
Notice of Reasons for Rejection dated Apr. 2, 2018 in Japanese Patent Application No. 2014-558975.
Notice of Reasons for Rejection dated Aug. 31, 2018 in Japanese Patent Application No. 2016-520632.
Notice of Reasons for Rejection dated Dec. 28, 2016 in Japanese Patent Application No. 2014-558975.
Notice of Reasons for Rejection dated Dec. 5, 2018 in Japanese Patent Application No. 2017-245295.
Notice of Reasons for Rejection dated Jul. 30, 2018 in Japanese Patent Application No. 2016-537867.
Notice of Reasons for Rejection dated Feb. 25, 2020 in Japanese Patent Application No. 2019-014564.
Notice of Reasons for Refusal dated May 11, 2020 in Japanese Patent Application No. 2017-549390.
Notice of Service of Disclosures to Opposing Counsel, dated Jun. 10, 2019 in the USDC for the District of Delaware, C.A. 18-1800 (RGA), 3 pp.
Notice of Service of Interrogatories and First Request of Documents and Things to Defendant 10X Genomics, Inc., dated Jul. 5, 2019 in the USDC for the District of Delaware, C.A. 18-1800 (RGA), 3 pp.
Notice, Consent, and Reference of a Civil Action to a Magistrate Judge (Rule 73.1), filed Nov. 15, 2018 in the USDC for the District of Delaware, C.A. 18-1800-RGA, 3 pp.
Notification Prior to Examination dated Nov. 27, 2019 in Israeli Patent Application No. 265478.
Novak et al., "Single-Cell Multiplex Gene Detection and Sequencing with Microfluidically Generated Agarose Emulsions," Angew. Chem. Int. Ed. 2011, 50, 390-395.
Novus Biologicals, "Fixation and Permeability in ICC IF," Novus Biologicals 2021, 1-3.
Nowak et al., "Does the KIR2DS5 gene protect from some human diseases?," PLoS One 2010, 5(8), in 6 pages.
Office Action dated Dec. 13, 2018 in Canadian Patent Application No. 2,865,575.
Office Action dated Dec. 19, 2017 in Chinese Patent Application No. 201480061859.1.
Office Action dated Dec. 27, 2016 in Chinese Patent Application No. 201380022187.9.
Office Action dated Feb. 15, 2018 in Canadian Patent Application No. 2,865,575.
Office Action dated Feb. 17, 2017 in Canadian Patent Application No. 2,865,575.
Office Action dated Jan. 2, 2019 in Chinese Patent Application No. 201480059505.3.
Office Action dated Jul. 14, 2017 in Chinese Patent Application No. 201380022187.9.
Office Action dated Jun. 6, 2016 in Chinese Patent Application No. 201380022187.9.
Office Action dated Sep. 7, 2018 in Chinese Patent Application No. 201480061859.1.
Office Action dated Mar. 4, 2020 in Canadian Patent Application No. 2,865,575.
Office Action dated Oct. 29, 2020 in Chinese Patent Application No. 2018800377201.
Office Action dated Jan. 4, 2021 in Japanese Patent Application No. 2017-549390.
Office Action dated Jan. 6, 2021 in Chinese Patent Application No. 201680052330.2.
Office Action dated Jan. 14, 2021 in Japanese Patent Application No. 2019-014564.
Office Action dated Jan. 15, 2021 in Korean Patent Application No. 10-2020-7033213.
Office Action dated Jan. 26, 2021 in Chinese Patent Application No. 201680007351.2.
Office Action dated Feb. 4, 2021 in Canadian Patent Application No. 2,865,575.
Office Action dated Feb. 20, 2021 in Chinese Patent Application No. 201680022865.5.
Office Action dated Mar. 1, 2021 in Chinese Patent Application No. 201680007652.5.
Office Action dated Mar. 2, 2021 in Chinese Patent Application No. 2016800157452.
Office Action dated Mar. 8, 2021 in Japanese Patent Application No. 2018-512152.
Office Action dated Mar. 16, 2021 in Chinese Patent Application No. 2018800377201.
Office Action dated May 10, 2021 in Japanese Patent Application No. 2019-566787.
Office Action dated May 21, 2021 in Chinese Patent Application No. 201680007351.2.
Office Action dated Jul. 26, 2021 in Korean Patent Application No. 10-2019-7011635.
Office Action dated Jul. 28, 2021 in Korean Patent Application No. 10-2020-7033213.
Office Action dated Aug. 13, 2021 in Chinese Patent Application No. 2017800587991.

(56) References Cited

OTHER PUBLICATIONS

Office Action dated Aug. 27, 2021 in Chinese Patent Application No. 2016800076525.
Office Action dated Aug. 30, 2021 in Japanese Patent Application No. 2019-540515.
Office Action dated Aug. 31, 2021 in Chinese Patent Application No. 2016800157452.
Office Action dated Aug. 31, 2021, in Korean Patent Application No. 10-2019-7038794.
Office Action dated Sep. 14, 2021, in Chinese Patent Application No. 2016800523302.
Office Action dated Oct. 21, 2021, in Chinese Patent Application No. 2016800073512.
Office Action dated Nov. 2, 2021, in Japanese Patent Application No. 2017-549390.
Office Action dated Dec. 23, 2021, in Japanese Patent Application No. 2019-566787.
Office Action dated Dec. 17, 2021 in Korean Patent Application No. 10-2018-7008560.
Office Action dated Jan. 13, 2022 in Chinese Patent Application No. 2017800587991.
Office Action dated Feb. 9, 2022 in Japanese Patent Application No. 2019-540515.
Office Action dated Feb. 23, 2022 in Chinese Patent Application No. 2016800523302.
Office Action dated Mar. 7, 2022 in Korean Patent Application No. 10-2022-7004715.
Office Action dated May 2, 2022 in European Patent Application No. 19787547.9.
Office Action dated May 17, 2022 in Australian Patent Application No. 2019204928.
Office Action dated May 24, 2022 in European Patent Application No. 20708266.0.
Office Action dated Jun. 28, 2022 in European Patent Application No. 16719706.0.
Office Action dated Aug. 2, 2022 in European Patent Application No. 19765601.0.
Office Action dated Aug. 1, 2022 in Korean Patent Application No. 10-2022-7017261.
Office Action dated Sep. 21, 2022 in Israel Patent Application No. 265478.
Office Action dated Jan. 30, 2023 in European Patent Application No. 19752792.2.
Office Action dated Feb. 8, 2023 in Australian Patent Application No. 2017331459.
Office Action dated Feb. 20, 2023 in European Patent Application No. 19723988.2.
Office Action dated Feb. 23, 2023 in European Patent Application No. 20816802.1.
Office Action dated Feb. 28, 2023 in Chinese Patent Application No. 2019111653930.
Office Action dated Nov. 24, 2022 in Chinese Patent Application No. 2018800147939.
Office Action dated Mar. 15, 2023 in European Patent Application No. 19787547.9.
Office Action dated Mar. 27, 2023 in European Patent Application No. 19836036.4.
Office Action dated Mar. 29, 2023 in Chinese Patent Application No. 2020800144092.
Office Action dated Apr. 10, 2023 in Japanese Patent Application No. 2022-030956.
Office Action dated Apr. 14, 2023 in Chinese Patent Application No. 201980082680.7.
Office Action dated Apr. 24, 2023 in Japanese Patent Application No. 2020-561800.
Office Action dated Apr. 24, 2023 in European Patent Application No. 21714995.4.
Office Action dated Apr. 26, 2023 in European Patent Application No. 18703156.2.
Office Action dated May 16, 2023 in European Patent Application No. 21707112.5.
Office Action dated May 26, 2023 in Chinese Patent Application No. 2019800373421.
Office Action dated May 27, 2023 in Chinese Patent Application No. 2019800656859.
Office Action dated May 30, 2023 in Chinese Patent Application No. 2019800653102.
Office Action dated Jun. 1, 2023 in Japanese Patent Application No. 2020-561807.
Office Action dated Jun. 16, 2023 in Chinese Patent Application No. 2019800708938.
Office Action dated Jun. 22, 2023 in Japanese Patent Application No. 2022-071002.
Office Action dated Jun. 28, 2023 in European Patent Application 19836239.4.
Office Action dated Jul. 12, 2023 in Chinese Patent Application No. 202080212600.
Office Action dated Jul. 12, 2023 in Canadian Patent Application No. 3,059,559.
Office Action Dated Jul. 13, 2023 in Chinese Patent Application No. 202080077712.7.
Office Action dated Jul. 28, 2023 in Chinese Patent Application No. 201880014793.9.
Office Action dated Jul. 29, 2023 in Chinese Patent Application No. 201980073850.5.
Office Action dated Jul. 31, 2023 in Chinese Patent Application No. 201980068704.3.
Office Action dated Jul. 31, 2023 in Chinese Patent Application No. 201980037175.0.
Office Action dated Aug. 11, 2023 in European Patent Application 19752792.2.
Office Action dated Aug. 21, 2023 in Japanese Patent Application No. 2021-507836.
Office Action dated Aug. 30, 2023 in Chinese Patent Application 2019111653930.
Office Action dated Aug. 31, 2023 in Chinese Patent Application 2020800483617.
Office Action dated Sep. 21, 2023 in Japanese Patent Application 2022-030956.
Office Action dated Sep. 21, 2023 in Israel Patent Application 265478.
Office Action dated Oct. 10, 2023 in European Patent Application 16719706.0.
Office Action dated Oct. 13, 2023 in Chinese Patent Application 202080014409.2.
Office Action dated Oct. 19, 2023 in Japanese Patent Application 2019-566787.
Office Action dated Oct. 23, 2023 in Japanese Patent Application 2021-517856.
Office Action dated Oct. 26, 2023 In Japanese Patent Application 2022-525692.
Office Action Dated Oct. 30, 2023 in Japanese Patent Application 2021-523956.
Office Action Dated Nov. 9, 2023 in Japanese Patent Application 2017-549390.
Office Action Dated Feb. 1, 2024 in Japanese Patent Application 2022-071002.
Ogawa, T. et al., "The Efficacy and further functional advantages of random-base molecular barcodes for absolute and digital quantification of nucleic acid molecules", Sci Rep 7, 2017 12576.
Ogino et al., "Quantification of PCR bias caused by a single nucleotide polymorphism in SMN gene dosage analysis," J Mol Diagn. 2002, 4(4), 185-190.
Opposition to Defendant's Motion to Dismiss Pursuant to Federal Rule of Civil Procedure 12(b)(6) dated Feb. 15, 2019, in the USDC for the District of Delaware, C.A. 18-800-RGA, 3 pp.
Oral Order by Judge Andrews Canceling Scheduling Conference set for May 8, 2019.
Order Scheduling ADR Mediation Teleconference, filed May 13, 2019 in the USDC for the District of Delaware, C.A. 18-1800-RGA, 4pp.

(56) References Cited

OTHER PUBLICATIONS

Order Setting Rule 16(b) Conference as Ordered by Judge Andrews Pursuant to Fed. R. Civ. P. 16(b), ruling dated Apr. 17, 2019 in the USDC District of Delaware, C.A. 18-1800-RGA, 1 pp.
O'Shea et al., "Analysis of T Cell Receptor Beta Chain CDR3 Size Using RNA Extracted from Formalin Fixed Paraffin Wax Embedded Tissue," Journal of Clinical Pathology 1997, 50(10), 811-814.
Ozkumur et al., "Inertial Focusing for Tumor Antigen-Dependent and -Independent Sorting of Rare Circulating Tumor Cells," Science Translational Medicine 2013, 5(179), 1-20.
Parameswaran et al., "A pyrosequencing-tailored nucleotide barcode design unveils opportunities for large-scale sample multiplexing," Nucleic Acids Res. 2007, 35(19), e130, 1-9.
Park et al., "Discovery of common Asian copy No. variants using integrated high-resolution array CGH and massively parallel DNA sequencing," Nat Genet. 2010, 42(5), 400-405.
Patanjali et al., "Construction of a uniform-abundance (normalized) CNDA library," Proceedings of the National Academy of Sciences 1991, 88(5), 1943-1947.
Peng et al., "Reducing amplification artifacts in high multiplex amplicon sequencing by using molecular barcodes," BMC Genomics 2015, 16(589), 1-12.
Pérez-Rentero et al., "Synthesis of Oligonucleotides Carrying Thiol Groups Using a Simple Reagent Derived from Threoninol," Molecules 2012, 17, 10026-10045.
Peterson et al., "Multiplexed quantification of proteins and transcripts in single cells," Nature Biotechnology 2017, 35, 936-939.
Pfaffl et al., "Determination of stable housekeeping genes, differentially regulated target genes andsample integrity: BestKeeper—Excel-based tool using pair-wise correlations," Biotechnology Letters, 26(6), 505-515.
Picelli et al., "Single-cell RNA-sequencing: The future of genome biology is now," RNA Biology 2017, 14(5), 637-650.
Picelli et al., "Tn5 transposase and tagmentation procedures for massively scaled sequencing projects," Genome Research 2014, 24(12), 2033-2040.
Pihlak et al., "Rapid genome sequencing with short universal tiling probes," Nature Biotechnology 2008, 26, 1-9.
Pinkel et al., "Comparative Genomic Hybridization," Annual Review of Genomics and Human Genetics 2005, 6, 331-354.
Plaintiff's Brief in Opposition to Defendant's Motion to Dismiss Pursuant to Fed. R. Civ. P. 12(b)(6), filed Mar. 29, 2019 in the USDC District of Delaware, C.A. No. 18-1800 (RGA), 27 pp.
Plaintiff's First Amended Complaint filed on Feb. 8, 2019, in the USDC for the District of Delaware, C.A. 18-1800-RGA, 178 pp.
Pleasance et al., "A small-cell lung cancer genome with complex signatures of tobacco exposure," Nature 2010, 463(7278), 184-190.
Plessy et al., "Population transcriptomics with single-cell resolution: a new field made possible by microfluidics: a technology for high throughput transcript counting and data-driven definition of cell types," Bioessays 2012, 35, 131-140.
Pre-interview communication dated Nov. 27, 2018 in U.S. Appl. No. 16/012,635.
Preissl et al., "Single-nucleus analysis of accessible chromatin in developing mouse forebrain reveals cell-type-specific transcriptional regulation," Nature Neuroscience 2018, 21(3), 432-439.
Prevette et al., "Polycation-Induced Cell Membrane Permeability Does Not Enhance Cellular Uptake or Expression Efficiency of Delivered DNA," Molecular Pharmaceutics 2010, 7(3), 870-883.
Pringle et al., "In Situ Hybridization Demonstration of Poly-Adenylated RNA Sequences in Formalin-Fixed Parafin Sections Using a Biotinylated Oligonucleotide Poly d(T) Probe," Journal of Pathology 1989, 158, 279-286.
Proposed Stipulated Protective Order Pursuant to Rule 26(c) of the Federal Rules of Civil Procedure, filed Jun. 20, 2019 in the USDC for the District of Delaware, C.A. 18-1800 (RGA), 26 pp.
Qiu et al., "DNA Sequence-Based "Bar Codes" for Tracking the Origins of Expressed Sequence Tags from a Maize cDNA Library Constructed Using Multiple mRNA Sources," Plant Physiol. 2003, 133, 475-481.
Quail et al., "SASI-Seq: sample assurance Spike-Ins, and highly differentiating 384 barcoding for Illumina sequencing," BMC Genomics 2014, 15(110), in 13 pages.
Raj et al., "Imaging individual mRNA molecules using multiple singly labeled probes," Nature Methods 2008, 5(10), 877-879.
Raj et al., "Single-Molecule Approaches to Stochastic Gene Expression," Annu Rev Biophys 2009, 38, 255-270.
Raj et al., "Stochastic mRNA synthesis in mammalian cells," PLoS Biol. 2006, 4(10) 1707-1719.
Rajeevan et al., "Global amplification of sense RNA: a novel method to replicate and archive mRNA for gene expression analysis," Genomics 2003, 82, 491-497.
Report on the Filing or Determination of an Action Regarding a Patent or Trademark filed Nov. 15, 2018 in the USDC for the District of Delaware, C.A. 18-1800-RGA, 2 pp.
Restriction Requirement dated Jun. 19, 2019 in U.S. Appl. No. 15/596,364.
Restriction Requirement dated Mar. 15, 2016 in U.S. Appl. No. 14/381,488.
Restriction Requirement dated Mar. 17, 2016 in U.S. Appl. No. 14/472,363.
Restriction Requirement dated Mar. 29, 2019 in U.S. Appl. No. 15/715,028.
Restriction Requirement dated Sep. 20, 2019 in U.S. Appl. No. 15/875,816.
Restriction Requirement dated Jun. 4, 2021 in U.S. Appl. No. 16/551,620.
Restriction Requirement dated Aug. 8, 2022 in U.S. Appl. No. 17/163,177.
Restriction Requirement dated Aug. 11, 2022 in U.S. Appl. No. 17/091,639.
Restriction Requirement dated Aug. 19, 2022 in U.S. Appl. No. 17/147,283.
Restriction Requirement dated Sep. 16, 2022 in U.S. Appl. No. 17/151,050.
Restriction Requirement dated Sep. 19, 2022 in U.S. Appl. No. 16/934,530.
Restriction Requirement dated Oct. 21, 2022 in U.S. Appl. No. 17/320,052.
Restriction Requirement dated Nov. 8, 2022 in U.S. Appl. No. 17/157,872.
Restriction Requirement dated Dec. 23, 2022 in U.S. Appl. No. 17/531,618.
Restriction Requirement dated Jan. 20, 2023 in U.S. Appl. No. 17/373,519.
Restriction Requirement dated Feb. 27, 2023 in U.S. Appl. No. 17/151,058.
Restriction Requirement dated Apr. 3, 2023 in U.S. Appl. No. 17/161,558.
Restriction Requirement dated Jun. 28, 2023 in U.S. Appl. No. 17/336,055.
Restriction Requirement dated Oct. 5, 2023 in U.S. Appl. No. 17/373,653.
Restriction Requirement dated Oct. 11, 2023 in U.S. Appl. No. 17/531,555.
Rhee et al., "Simultaneous detection of mRNA and protein stem cell markers in live cells," BMC Biotechnology 2009, 9(30), 1-10.
Roche Diagnostics GmbH, "Genome Sequencer 20 System: First to the Finish," 2006, 1-40.
Rule 7.1 Disclosure Statement dated Nov. 15, 2018 in the USDC for the District of Delaware, C.A. 18-1800-RGA, 1 pp.
Sah et al., "Complete Genome Sequence of a 2019 Novel Coronavirus (SARS-CoV-2) Strain Isolated in Nepal," Microbiol Resour Announc. 2020, 9(11), e00169-20, 3 pp.
Sano et al., "Immuno-PCR: Very Sensitive Antigen Detection by Means of Specific Antibody-DNA Conjugates," Science 1992, 258, 120-122.
Sasagawa et al., "Quartz-Seq: a highly reproducible and sensitive single-cell RNA sequencing method, reveals non-genetic gene-expression heterogeneity," Genome Biology 2013, 14, R31.
Sasuga et al., Single-cell chemical lysis method for analyses of intracellular molecules using an array of picoliter-scale microwells, Anal Chem 2008, 80(23), 9141-9149.

(56) References Cited

OTHER PUBLICATIONS

Satija et al., Spatial reconstruction of single-cell gene expression data, Nature Biotechnology 2015, 33(5), 495-508.
Scheduling Order pursuant to Local Rule 16.1(b), filed May 7, 2019 in the USDC for the District of Delaware, C.A. 18-1800-RGA, 10 pp.
Scheduling Order Signed by Judge Andrews, dated May 8, 2019 in the USDC for the District of Delaware, C.A. 18-1800-RGA, 10 pp.
Schmitt et al., "Detection of ultra-rare mutations by next-generation sequencing," Proc Natl Acad Sci 2012, 109(36), 1-6.
Schouten et al., "Relative quantification of 40 nucleic acid sequences by multiplex ligation-dependent probe amplification," Nucleic Acids Research 2002, 30(12), e57.
Shapiro et al., "Single-cell sequencing-based technologies will revolutionize whole-organism science," Nature Reviews Genetics 2013, 14, 618-629.
Search and Examination Report dated Aug. 26, 2015 in United Kingdom Patent Application No. 1511591.8.
Search Report and Written Opinion dated Jan. 26, 2016 in Singapore Patent Application No. 1120140527W.
Search Report and Written Opinion dated Aug. 26, 2020 in Singapore Patent Application No. 10201806890V.
Sebat et al., "Large-Scale Copy Number Polymorphism in the Human Genome," Science 2004, 305, 525-528.
Shahi et al., "Abseq: ultrahigh-throughput single cell protein profiling with droplet microfluidic barcoding," Scientific Reports 2017, 7(44447), 1-10.
Shalek et al., "Single-cell transcriptomics reveals bimodality in expression and splicing in immune cells," Nature 2013, 498(7453), 236-240.
Shendure et al., "Next-generation DNA sequencing," Nature Biotechnology 2008, 26(10), 1135-1145.
Shiroguchi et al., "Digital RNA sequencing minimizes sequence-dependent bias and amplification noise with optimized single-molecule barcodes," Proc Natl Acad Sci 2012, 109(4):1347-1352.
Shoemaker et al., "Quantitative phenotypic analysis of yeast deletion mutants using a highly parallel molecular bar-coding strategy," Nature Genetics 1996, 14, 450-456.
Shortreed et al., "A thermodynamic approach to designing structure-free combinatorial DNA word sets," Nucleic Acids Res. 2005, 33(15), 4965-4977.
Shum et al., "Quantitation of mRNA Transcripts and Proteins Using the BD Rhapsody™ Single-Cell Analysis System," Adv Exp Med Biol. 2019, 1129, 63-79.
Simpson et al., "Copy number variant detection in inbred strains from short read sequence data," Bioinformatics 2010, 26(4), 565-567.
Smith et al., "Highly-multiplexed barcode sequencing: an efficient method for parallel analysis of pooled samples," Nucleic Acids Research 2010, 38(13), e142, 1-7.
Soares et al., "Construction and characterization of a normalized cDNA library," Proc. Natl., Acad. Sci. 1994, 91, 9228-9232.
Sogin et al., "Microbial diversity in the deep sea and the underexplored "rare biosphere"," PNAS 2008, 103(32), 12115-12120.
Sommer et al., "Minimal homology requirements for PCR primers," Nucleic Acids Research 1989, 17(16), 6749.
Song et al., "Design rules for size-based cell sorting and sheathless cell focusing by hydrophoresis," Journal of Chromatography A 2013, 1302, 191-196.
Song et al., DNase-seq: a high-resolution technique for mapping active gene regulatory elements across the genome from mammalian cells, Cold Spring Harb Protoc 2010, 2, in 13 pages.
Sos et al., "Characterization of chromatin accessibility with a transposome hypersensitive sites sequencing (THS-seq) assay," Genome Biology 2016, 17(20), in 15 pages.
Spanova et al., "Magnetic hydrophilic methacrylate-based polymer microspheres designed for polymerase chain reaction applications", Journal of Chromatography vol. 800, 2004, 27-32.
Soumillon et al., "Characterization of directed differentiation by high-throughput single-cell RNA-Seq," bioRxiv 2014, 1-13.

Speicher et al., "The new cytogenetics: blurring the boundaries with molecular biology," Nature Reviews Genetics 2005, 6(10), 782-792.
Statement of Opposition dated Jul. 21, 2016 filed against European Patent No. EP2414548B1.
Statement of Opposition filed against European Patent No. EP2414548B1 on Jul. 26, 2016.
Statement of Opposition of Strawman Limited filed against European Patent No. EP2414548B1 on Jul. 19, 2016.
Statement regarding Third-Party Submission filed on Jun. 6, 2018 for U.S. Appl. No. 15/847,752.
Stipulated Protective Order Pursuant to Rule 26(c) of the Federal Rules of Civil Procedure, dated Jun. 21, 2019 in the USDC for the District of Delaware, C.A. 18-1800 (RGA), 26 pp.
Stipulation and Order to Extend Time to File Opposition to Motion to Dismiss, and Reply in Support of the Motion, dated Jan. 28, 2019 in the USDC for the District of Delaware, C.A. 18-1800-RGA, 2 pp.
Stoeckius et al., "Large-scale simultaneous measurement of epitopes and transcriptomes in single cells," Nature Methods 2017, 14(9), 865-868.
Stoeckius et al., "Cell Hashing with barcoded antibodies enables multiplexing and doublet detection for single cell genomics," Genome Biology 2018, 19(224), 1-12.
Stratagene 1988 Catalog, Gene Characterization Kits, 39.
Subkhankulova et al., "Comparative evaluation of linear and exponential amplification techniques for expression profiling at the single cell level," Genome Biology 2006, 7(3), 1-16.
Submission dated Jan. 15, 2018 in preparation for upcoming oral proceedings in opposition against European Patent No. EP2414548B1.
Summons in a Civil Action to Defendant 10X Genomics, Inc. filed Nov. 16, 2018 in the USDC for the District of Delaware, Civil Action No. 18-1800, 2 pp.
Summons to Attend Oral Proceedings dated Nov. 16, 2020 in European Patent Application No. 17202409.3.
Summons to Attend Oral Proceedings Dated Aug. 8, 2023 in European Patent Application No. 14749671.5.
Sun et al., "Ultra-deep profiling of alternatively spliced Drosophila Dscam isoforms by circularization-assisted multi-segment sequencing," EMBO J. 2013, 32(14), 2029-2038.
Takahashi et al., "Novel technique of quantitative nested real-time PCR assay for Mycobacterium tuberculosis DNA," Journal of Clinical Microbiology 2006, 44, 1029-1039.
Takara Bio, "SMARTer Human BCR IgG IgM H/K/L Profiling Kit User Manual," Takara Bio USA Inc. 2019, 1-22.
Tan et al., "Genome-wide comparison of DNA hydroxymethylation in mouse embryonic stem cells andneural progenitor cells by a new comparative hMeDIP-seq method," Nucleic Acids Res. 2013, 41(7), e84, 1-12.
Tang et al., "RNA-Seq analysis to capture the transcriptome landscape of a single cell," Nature Protocols 2010, 5(3), 516-535.
Taudien et al., "Haplotyping and copy number estimation of the highly polymorphic human beta-defensin locus on 8p23 by 454 amplicon sequencing," BMC Genomics 2010, 11, 252, 1-14.
The Tibbs Times, UNC bioscience newsletter, Apr. 2010, 1-17.
Third-Party Submission filed on May 21, 2018 for U.S. Appl. No. 15/847,752.
Tomaz et al., "Differential methylation as a cause of allele dropout at the imprinted GNAS locus," Genet Test Mol Biomarkers 2010, 14(4), 455-460.
TotalSeq™—A0251 anti-human Hashtag 1 Antibody, BioLegend®, Jul. 2018, 1-10.
Trzupek et al., "Discovery of CD80 and CD86 as recent activation markers on regulatory T cells by protein-RNA single-cell analysis", Genome Medicine 2020, 12(1), in 22 pages.
Treutlein et al., Reconstructing lineage hierarchies of the distal lung epithelium using single-cell RNA-seq, Nature 2014, 509, 371-375.
Ullal et al., "Cancer cell profiling by barcoding allows multiplexed protein analysis in fine needle aspirates," Sci Transl Med. 2014, 6(219), 22 pp.
Uellendahl-Werth et al., "A benchmark of hemoglobin blocking during library preparation for mRNA Sequencing of human blood samples," Scientific Reports 2020, 10(1), 5630.

(56) References Cited

OTHER PUBLICATIONS

Unopposed Motion to Extend Time for Defendant's Response, dated Dec. 4, 2018 in the USDC for the District of Delaware, C.A. 18-1800-(RGA), 2 pp.
Vandesompele et al., "Accurate normalization of real-time quantitative RT-PCR data by geometric averaging of multiple internal control genes," Genome Biology 2002, 3(7), 1-12.
Velculescu et al., "Characterization of the Yeast Transcriptome," Cell 1997, 88, 243-251.
Velculescu et al., "Serial Analysis of Gene Expression," Science 1995, 270(5235), 484-487.
Vestheim et al., "Application of Blocking Oligonucleotides to Improve Signal-to-Noise Ratio in a PCR," Methods in Molecular Biology 2011, 687, 265-274.
Vogelstein et al., "Digital PCR," Proc. Natl. Acad. Sci. 1999, 96, 9236-9241.
Vollbrecht et al., "Validation and comparison of two NGS assays for the detection of EGFR T790M resistance mutation in liquid biopsies of NSCLC patients," Oncotarget 2018, 9(26), 18529-18539.
Walker et al., "Isothermal in vitro amplification of DNA by a restriction enzyme/DNA polymerase system," Proc Natl Acad Sci 1992, 89, 392-396.
Walsh et al., "Detection of inherited mutations for breast and ovarian cancer using genomic capture and massively parallel sequencing," Proc Natl Acad Sci 2010, 107(28), 12629-12633.
Wang et al., "Advances and applications of single-cell sequencing technologies," Molecular Cell 2015, 58, 598-609.
Wang et al., "Combining Gold Nanoparticles with Real-Time Immuno-PCR for Analysis of HIV p24 Antigens," Proceedings of ICBBE 2007, 1198-1201.
Wang et al., "iCLIP predicts the dual splicing effects of TIA-RNA interactions," PLoS Biol 2010, 8(10), e1000530, 1-16.
Wang et al., "RNA-Seq: a revolutionary tool for transcriptomics," Nature Reviews Genetics 2009, 10(1), 57-63.
Wang et al., "Tagmentation-based whole-genome bisulfite sequencing," Nature Protocols 2013, 8(10), 2022-2032.
Wangsanuwat et al., "Efficient and cost-effective bacterial mRNA sequencing from low input samples through ribosomal RNA depletion," BMC Genomics 2020, 21(1), 1-12.
Warren et al., "Transcription factor profiling in individual hematopoietic progenitors by digital RT-PCR," PNAS 2006, 103(47), 17807-17812.
Weber et al., "A real-time polymerase chain reaction assay for quantification of allele ratios and correction of amplification bias," Anal Biochem. 2003, 320, 252-258.
Weibrecht et al., "Proximity ligation assays: a recent addition to the proteomics toolbox," Expert Rev. Proteomics 2010, 7(3), 401-409.
Weiner et al., "Kits and their unique role in molecular biology: a brief retrospective," BioTechniques 2008, 44(5), 701-704.
White et al., "High-throughput microfluidic single-cell RT-qPCR," PNAS 2011, 108(34), 13999-14004.
Wittes et al., "Searching for Evidence of Altered Gene Expression: a Comment on Statistical Analysis of Microarray Data," Journal of the National Cancer Institute 1999, 91(5), 400-401.
Wodicka et al., "Genome-wide expression monitoring in *Saccharomyces cerevisiae*," Nature Biotechnology 1997, 15, 1359-1367.
Wojdacz et al., "Primer design versus PCR bias in methylation independent PCR amplifications," Epigenetics 2009, 4(4), 231-234.
Wood et al., "Using next-generation sequencing for high resolution multiplex analysis of copy number variation from nanogram quantities of DNA from formalin-fixed paraffin-embedded specimens," Nucleic Acids Res. 2010, 38(14), 1-14.
Written Submission of Publications dated Jun. 14, 2018 in Japanese Patent Application No. 2016-537867.
Wu et al., "Quantitative assessment of single-cell RNA-sequencing methods," Nat Methods 2014, 11(1), 41-46.
Wu, et al., "Time-resolved assessment of single-cell protein secretion by sequencing", bioRxiv, Dec. 21, 2021.
Yang & Zhao, "Quantitative Analysis of Nonoxynol-9 in Blood," Contraception 1991, 43(2), 161-166.
Yandell et al., "A probabilistic disease-gene finder for personal genomes," Genome Res. 2011, 21(9), 1529-1542.
Ye et al., Fluorescent microsphere-based readout technology for multiplexed human single nucleotide polymorphism analysis and bacterial identification, Human Mutation 2001, 17(4), 305-316.
Yoon et al., Sensitive and accurate detection of copy number variants using read depth of coverage, Genome Res. 2009, 19, 1586-1592.
Zagordi et al., "Error correction of next-generation sequencing data and reliable estimation of HIV quasispecies," Nucleic Acids Research 2010, 38(21), 7400-7409.
Zeberg et al., "The major genetic risk factor for severe COVID-19 is inherited from Neanderthals," Nature 2020, 587(7835), 1-13.
Zhang et al., "Immunoaffinity Purification of Plasma Membrane with Secondary Antibody Superparamagnetic Beads," Journal of Proteome 2006, 6, 34-43.
Zhang et al., "DNA-based hybridization chain reaction for amplified bioelectronic signal and ultrasensitive detection of proteins," Anal Chem. 2012, 84, 5392-5399.
Zhang et al., "The impact of next-generation sequencing on genomics," J Genet Genomics 2011, 38(3), 95-109.
Zhao et al., "Homozygous Deletions and Chromosome Amplifications in Human Lung Carcinomas Revealed by Single Nucleotide Polymorphism Array Analysis," Cancer Research 2005, 65(13), 5561-5570.
Zheng et al., "Haplotyping germline and cancer genomes with high-throughput linked-read sequencing," Nature Biotechnology 2016, 34(3), 303-311.
Zhou et al., "Counting alleles reveals a connection between chromosome 18q loss and vascular invasion," Nature Biotechnology 2001, 19, 78-81.
Zhou et al., "Photocleavable Peptide-Oligonucleotide Conjugates for Protein Kinase Assays by MALDI-TOF MS," Mol. BioSyst. 2012, 8, 2395-2404.
Zhu et al., "Reverse Transcriptase Template Switching: A SMART Approach for Full-Length cDNA Library Construction," BioTechniques 2001, 30(4), 892-897.
Zheng, et al. "Aptamer-Functionalized Barcode Particles for the Capture and Detection of Multiple Types of Circulating Tumor Cells." Advanced materials (Weinheim), 2014, 26, 7333-7338.
Zhou and Rossi. "Aptamers as Targeted Therapeutics: Current Potential and Challenges." Nature reviews. Drug discovery, 2017, 16:181-202.
Zhulidov et al., "Simple cDNA normalization using kamchatka crab duplex-specific nuclease," Nucleic Acids Research. 2004, 32(3)e37.

\* cited by examiner

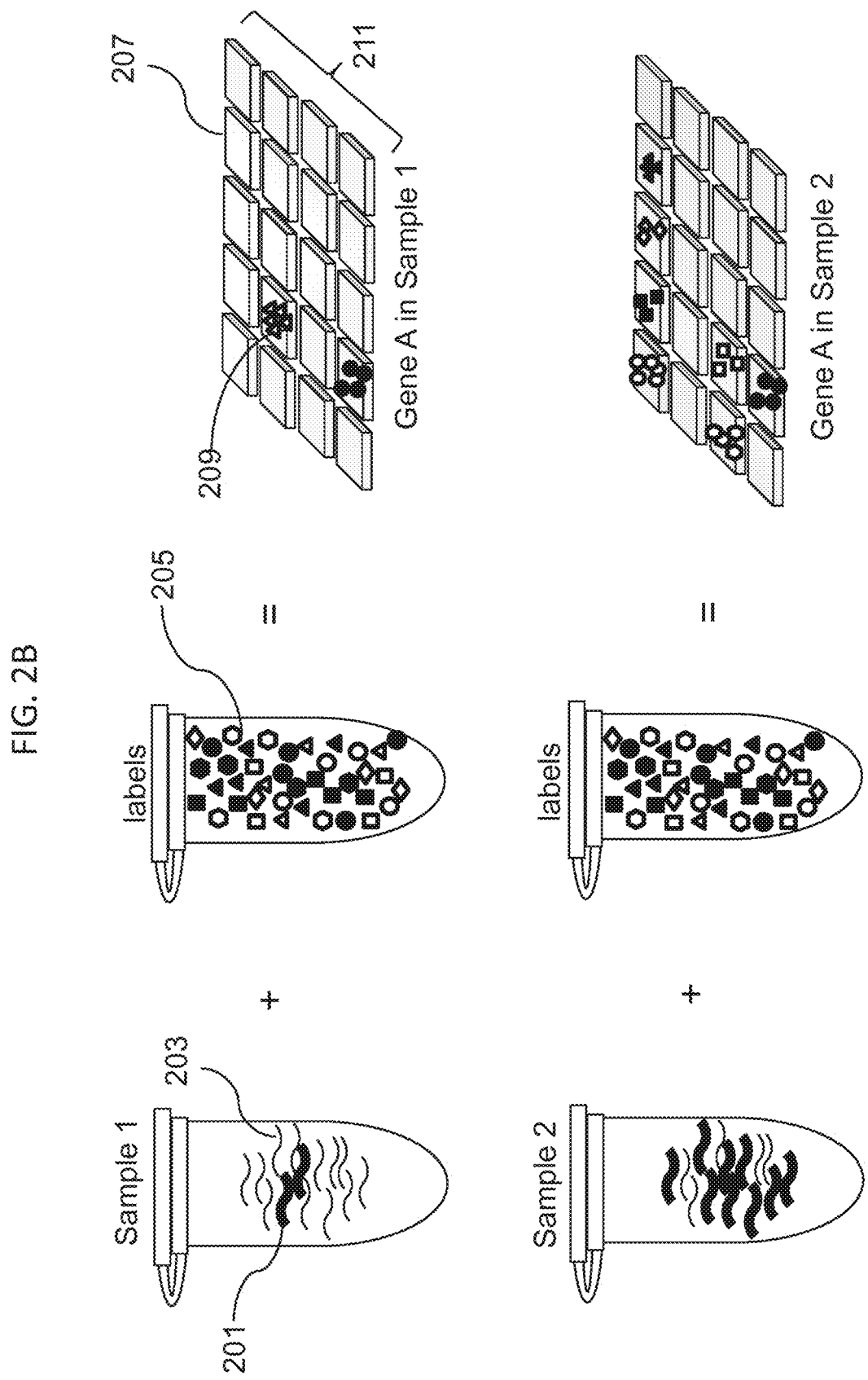

DIGITAL COUNTING OF INDIVIDUAL MOLECULES BY STOCHASTIC ATTACHMENT OF DIVERSE LABELS

RELATED APPLICATIONS

This application is a continuation of U.S. patent application Ser. No. 16/846,133, filed on Apr. 10, 2020, which is a continuation of U.S. patent application Ser. No. 15/217,886, filed on Jul. 22, 2016, now U.S. Pat. No. 10,619,203, which is a continuation of U.S. patent application Ser. No. 14/281,706, filed on May 19, 2014, now U.S. Pat. No. 9,816,137, which is a continuation of U.S. patent application Ser. No. 12/969,581, filed on Dec. 15, 2010, now U.S. Pat. No. 8,835,358, which claims priority to U.S. Provisional Application No. 61/286,768, filed on Dec. 15, 2009. The content of each of these related applications is incorporated herein by reference herein in its entirety.

REFERENCE TO SEQUENCE LISTING

The present application is being filed along with a Sequence Listing in electronic format. The Sequence Listing is provided as a file entitled 68EB-298684-US12, created Feb. 8, 2023, which is 2,543,616 bytes in size. The information in the electronic format of the Sequence Listing is incorporated herein by reference in its entirety.

FIELD OF THE INVENTION

Methods, compositions and products for counting individual molecules by stochastic attachment of diverse labels from a set of labels, followed by amplification and detection are disclosed.

BACKGROUND OF THE INVENTION

Many processes are characterized or regulated by the absolute or relative amounts of a plurality of items. For example, in biology, the level of expression of particular genes or groups of genes or the number of copies of chromosomal regions can be used to characterize the status of a cell or tissue. Analog methods such as microarray hybridization methods and real-time PCR are alternatives, but digital readout methods such as those disclosed herein have advantages over analog methods. Methods for estimating the abundance or relative abundance of genetic material having increased accuracy of counting would be beneficial.

The availability of convenient and efficient methods for the accurate identification of genetic variation and expression patterns among large sets of genes may be applied to understanding the relationship between an organism's genetic make-up and the state of its health or disease, Collins et al, Science, 282: 682-689 (1998). In this regard, techniques have been developed for the analysis of large populations of polynucleotides based either on specific hybridization of probes to microarrays, e.g. Lockhart et al. Hacia et al, Nature Genetics, 21: 4247 (1999), or on the counting of tags or signatures of DNA fragments, e.g. Velculescu et al, Science, 270: 484487 (1995); Brenner et al, Nature Biotechnology, 18: 630-634 (2000). These techniques have been used in discovery research to identify subsets of genes that have coordinated patterns of expression under a variety of circumstances or that are correlated with, and predictive of events, of interest, such as toxicity, drug responsiveness, risk of relapse, and the like, e.g. Golub et al, Science, 286: 531-537 (1999); Alizadeh et al, Nature, 403: 503-511 (2000); Perou et al, Nature, 406: 747-752 (2000); Shipp et al, Nature Medicine, 8: 68-74 (2002); Hakak et al, Proc. Natl. Acad. Sci., 98: 47454751 (2001); Thomas et al, Mol. Pharmacol., 60: 1189-1194 (2001); De Primo et al, BMC Cancer 2003, 3:3; and the like. Not infrequently the subset of genes found to be relevant has a size in the range of from ten or under to a few hundred.

In addition to gene expression, techniques have also been developed to measure genome-wide variation in gene copy number. For example, in the field of oncology, there is interest in measuring genome-wide copy number variation of local regions that characterize many cancers and that may have diagnostic or prognostic implications. For a review see Zhang et al. Annu. Rev. Genomics Hum. Genet. 2009. 10:451-81.

While such hybridization-based techniques offer the advantages of scale and the capability of detecting a wide range of gene expression or copy number levels, such measurements may be subject to variability relating to probe hybridization differences and cross-reactivity, element-to-element differences within microarrays, and microarray-to-microarray differences, Audic and Claverie, Genomic Res., 7: 986-995 (1997); Wittes and Friedman, J. Natl. Cancer Inst. 91: 400-401 (1999).

On the other hand, techniques that provide digital representations of abundance, such as SAGE (Velculescu et al, cited above) or MPSS (Brenner et al, cited above), are statistically more robust; they do not require repetition or standardization of counting experiments as counting statistics are well-modeled by the Poisson distribution, and the precision and accuracy of relative abundance measurements may be increased by increasing the size of the sample of tags or signatures counted, e.g. Audic and Claverie (cited above).

Both digital and non-digital hybridization-based assays have been implemented using oligonucleotide tags that are hybridized to their complements, typically as part of a detection or signal generation schemes that may include solid phase supports, such as microarrays, microbeads, or the like, e.g. Brenner et al, Proc. Natl. Acad. Sci., 97: 1665-1670 (2000); Church et al, Science, 240: 185-188 (1988); Chee, Nucleic Acids Research, 19: 3301-3305 (1991); Shoemaker et al., Nature Genetics, 14: 450456 (1996); Wallace, U.S. Pat. No. 5,981,179; Gerry et al, J. Mol. Biol., 292: 251-262 (1999); Fan et al., Genome Research, 10: 853-860 (2000); Ye et al., Human Mutation, 17: 305-316 (2001); and the like. Bacterial transcript imaging by hybridization of total RNA to nucleic acid arrays may be conducted as described in Saizieu et al., Nature Biotechnology, 16:45-48 (1998). Accessing genetic information using high density DNA arrays is further described in Chee et al., Science 274:610-614 (1996). Tagging approaches have also been used in combination with next-generation sequencing methods, see for example, Smith et al. NAR (May 11, 2010), 1-7.

A common feature among all of these approaches is a one-to-one correspondence between probe sequences and oligonucleotide tag sequences. That is, the oligonucleotide tags have been employed as probe surrogates for their favorable hybridizations properties, particularly under multiplex assay conditions.

Determining small numbers of biological molecules and their changes is essential when unraveling mechanisms of cellular response, differentiation or signal transduction, and in performing a wide variety of clinical measurements. Although many analytical methods have been developed to measure the relative abundance of different molecules through sampling (e.g., microarrays and sequencing), few techniques are available to determine the absolute number of molecules in a sample. This can be an important goal, for example in single cell measurements of copy number or stochastic gene expression, and is especially challenging when the number of molecules of interest is low in a background of many other species. As an example, measuring the relative copy number or expression level of a gene across a wide number of genes can currently be performed using PCR, hybridization to a microarray or by direct sequence counting. PCR and microarray analysis rely on the specificity of hybridization to identify the target of interest for amplification or capture respectively, then yield an analog signal proportional to the original number of molecules. A major advantage of these approaches is in the use of hybridization to isolate the specific molecules of interest within the background of many other molecules, generating specificity for the readout or detection step. The disadvantage is that the readout signal to noise is proportional to all molecules (specific and non-specific) specified by selective amplification or hybridization. The situation is reversed for sequence counting. No intended sequence specificity is imposed in the sequence capture step, and all molecules are sequenced. The major advantage is that the detection step simply yields a digital list of those sequences found, and since there is no specificity in the isolation step, all sequences must be analyzed at a sufficient statistical depth in order to learn about a specific sequence. Although very major technical advances in sequencing speed and throughput have occurred, the statistical requirements imposed to accurately measure small changes in concentration of a specific gene within the background of many other sequences requires measuring many sequences that don't matter to find the ones that do matter. Each of these techniques, PCR, array hybridization and sequence counting is a comparative technique in that they primarily measure relative abundance, and do not typically yield an absolute number of molecules in a solution. A method of absolute counting of nucleic acids is digital PCR (B. Vogelstein, K. W. Kinzler, *Proc Natl Acad Sci USA* 96, 9236 (Aug. 3, 1999)), where solutions are progressively diluted into individual compartments until there is an average probability of one molecule per two wells, then detected by PCR. Although digital PCR can be used as a measure of absolute abundance, the dilutions must be customized for each type of molecule, and thus in practice is generally limited to the analysis of a small number of different molecules.

SUMMARY OF THE INVENTION

High-sensitivity single molecule digital counting by the stochastic labeling of a collection of identical molecules is disclosed. Each copy of a molecule randomly chooses from a non-depleting reservoir of diverse labels. The uniqueness of each labeled molecule is determined by the statistics of random choice, and depends on the number of copies of identical molecules in the collection compared to the diversity of labels. The size of the resulting set of labeled molecules is determined by the stochastic nature of the labeling process, and analysis reveals the original number of molecules. When the number of copies of a molecule to the diversity of labels is low, the labeled molecules are highly unique, and the digital counting efficiency is high. This stochastic transformation relaxes the problem of counting molecules from one of locating and identifying identical molecules to a series of yes/no digital questions detecting whether preprogrammed labels are present. The conceptual framework for stochastic mapping of a variety of molecule types is developed and the utility of the methods are demonstrated by stochastically labeling 360,000 different fragments of the human genome. The labeled fragments for a target molecule of choice are detected with high specificity using a microarray readout system, and with DNA sequencing. The results are consistent with a stochastic process, and yield highly precise relative and absolute counting statistics of selected molecules within a vast background of other molecules.

Methods are disclosed herein for digital counting of individual molecules of one or more targets. In preferred embodiments the targets are nucleic acids, but may be a variety of biological or non-biological elements. Targets are labeled so that individual occurrences of the same target are marked by attachment of a different label to difference occurrences. The attachment of the label confers a separate, determinable identity to each occurrence of targets that may otherwise be indistinguishable. Preferably the labels are different sequences that tag or mark each target occurrence uniquely. The resulting modified target comprises the target sequence and the unique identifier (which may be referred to herein as tag, counter, label, or marker). The junction of the target and identifier forms a uniquely detectable mechanism for counting the occurrence of that copy of the target. The attachment of the identifier to each occurrence of the target is a random sampling event. Each occurrence of target could choose any of the labels. Each identifier is present in multiple copies so selection of one copy does not remove that identifier sequence from the pool of identifiers so it is possible that the same identifier will be selected twice. The probability of that depends on the number of target occurrences relative to the number of different identifier sequences.

Each stochastic attachment event, where a target occurrence is attached to a unique identifier, results in the creation of a novel sequence formed at the junction of the identifier and the target. For a given target, all resulting products will contain the same target portion, but each will contain a different identifier sequence (T1L1, T1L2, . . . T1LN where N is the number of different occurrences of target 1, "T1" and L is the identifier, L1, L2 . . . LN). In preferred aspects the occurrences are detected by hybridization. In some aspects the methods and systems include a probe array comprising features, wherein each feature has a different combination of target sequence with identifiers, 1 to N wherein N is the number of unique identifiers in the pool of identifiers. The array has N features for each target, so if there are 8 targets to be analyzed there are 8 times N features on the array to interrogate the 8 targets.

BRIEF DESCRIPTION OF THE DRAWINGS

FIG. 2B shows a schematic of detection of labeled targets on an array having features that are label specific and target specific.

DETAILED DESCRIPTION OF THE INVENTION

Figure 1:
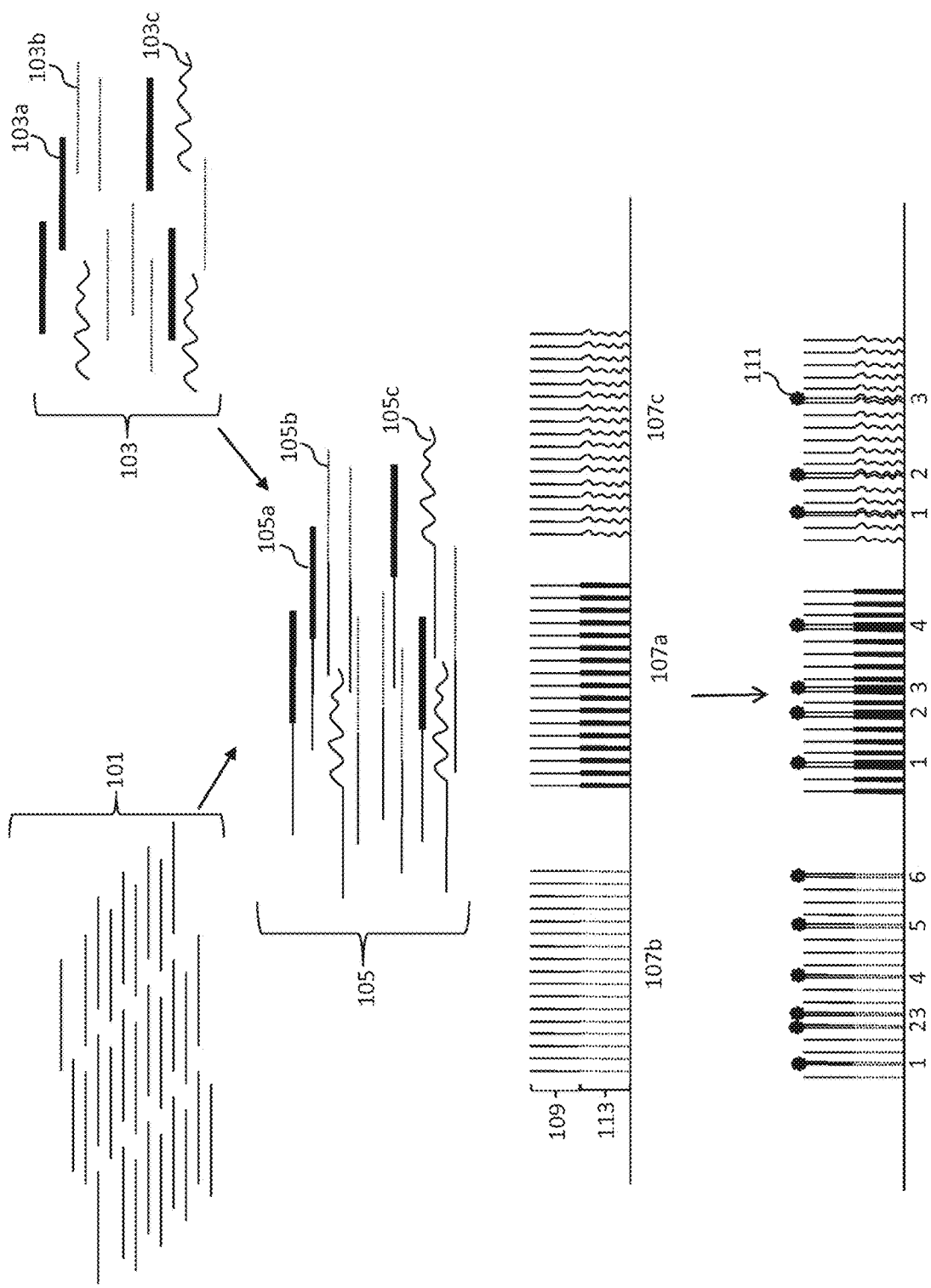
FIG. 1 is a schematic of a method of stochastic labeling and counting by hybridization to an array of support bound probes.

Reference will now be made in detail to exemplary embodiments of the invention. While the invention will be described in conjunction with the exemplary embodiments, it will be understood that they are not intended to limit the invention to these embodiments. On the contrary, the invention is intended to cover alternatives, modifications and equivalents, which may be included within the spirit and scope of the invention.

The invention has many preferred embodiments and relies on many patents, applications and other references for details known to those of the art. Therefore, when a patent, application, or other reference, such as a printed publication, is cited or repeated below, it should be understood that it is incorporated by reference in its entirety for all purposes and particularly for the proposition that is recited.

As used in this application, the singular form "a," "an," and "the" include plural references unless the context clearly dictates otherwise. For example, the term "an agent" includes a plurality of agents, including mixtures thereof An individual is not limited to a human being, but may also be other organisms including, but not limited to, mammals, plants, bacteria, or cells derived from any of the above.

Throughout this disclosure, various aspects of this invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

The practice of the present invention may employ, unless otherwise indicated, conventional techniques and descriptions of organic chemistry, polymer technology, molecular biology (including recombinant techniques), cell biology, biochemistry, and immunology, which are within the skill of the art. Such conventional techniques include polymer array synthesis, hybridization, ligation, and detection of hybridization using a label. Specific illustrations of suitable techniques can be had by reference to the example herein below. However, other equivalent conventional procedures can, of course, also be used. Such conventional techniques and descriptions can be found in standard laboratory manuals such as *Genome Analysis: A Laboratory Manual Series* (*Vols. I-IV*), *Using Antibodies: A Laboratory Manual, Cells: A Laboratory Manual, PCR Primer: A Laboratory Manual*, and *Molecular Cloning: A Laboratory Manual* (all from Cold Spring Harbor Laboratory Press), Gait, "*Oligonucleotide Synthesis: A Practical Approach*" 1984, IRL Press, London, Nelson and Cox (2000), Lehninger et al., (2008) *Principles of Biochemistry* 5th Ed., W.H. Freeman Pub., New York, NY and Berg et al. (2006) *Biochemistry*, $6^{th}$ Ed., W.H. Freeman Pub., New York, NY, all of which are herein incorporated in their entirety by reference for all purposes.

The present invention can employ solid substrates, including arrays in some preferred embodiments. Methods and techniques applicable to polymer (including protein) array synthesis have been described in U.S. Patent Pub. No. 20050074787, WO 00/58516, U.S. Pat. Nos. 5,143,854, 5,242,974, 5,252,743, 5,324,633, 5,384,261, 5,405,783, 5,424,186, 5,451,683, 5,482,867, 5,491,074, 5,527,681, 5,550,215, 5,571,639, 5,578,832, 5,593,839, 5,599,695, 5,624,711, 5,631,734, 5,795,716, 5,831,070, 5,837,832, 5,856,101, 5,858,659, 5,936,324, 5,968,740, 5,974,164, 5,981,185, 5,981,956, 6,025,601, 6,033,860, 6,040,193, 6,090,555, 6,136,269, 6,269,846 and 6,428,752, in PCT Publication No. WO 99/36760 and WO 01/58593, which are all incorporated herein by reference in their entirety for all purposes.

Patents that describe synthesis techniques in specific embodiments include U.S. Pat. Nos. 5,412,087, 6,147,205, 6,262,216, 6,310,189, 5,889,165, and 5,959,098. Nucleic acid arrays are described in many of the above patents, but the same techniques may be applied to polypeptide arrays.

The present invention also contemplates many uses for polymers attached to solid substrates. These uses include gene expression monitoring, profiling, library screening, genotyping and diagnostics. Gene expression monitoring and profiling methods can be shown in U.S. Pat. Nos. 5,800,992, 6,013,449, 6,020,135, 6,033,860, 6,040,138, 6,177,248 and 6,309,822. Genotyping and uses therefore are shown in U.S. Patent Publication Nos. 20030036069 and 20070065816 and U.S. Pat. Nos. 5,856,092, 6,300,063, 5,858,659, 6,284,460, 6,361,947, 6,368,799 and 6,333,179. Other uses are embodied in U.S. Pat. Nos. 5,871,928, 5,902,723, 6,045,996, 5,541,061, and 6,197,506.

The present invention also contemplates sample preparation methods in certain embodiments. Prior to or concurrent with analysis, the sample may be amplified by a variety of mechanisms. In some aspects nucleic acid amplification methods such as PCR may be combined with the disclosed methods and systems. See, for example, *PCR Technology: Principles and Applications for DNA Amplification* (Ed. H. A. Erlich, Freeman Press, NY, NY, 1992); *PCR Protocols: A Guide to Methods and Applications* (Eds. Innis, et al., Academic Press, San Diego, C A, 1990); Mattila et al., *Nucleic Acids Res.* 19, 4967 (1991); Eckert et al., *PCR Methods and Applications* 1, 17 (1991); PCR (Eds. McPherson et al., IRL Press, Oxford); and U.S. Pat. Nos. 4,683,202, 4,683,195, 4,800,159, 4,965,188, and 5,333,675, each of which is incorporated herein by reference in their entireties for all purposes. Enzymes and related methods of use in molecular biology that may be used in combination with the disclosed methods and systems are reviewed, for example, in Rittie and Perbal, *J. Cell Commun. Signal.* (2008) 2:25-45. The sample may be amplified on the array. See, for example, U.S. Pat. No. 6,300,070 and which is incorporated herein by reference in its entirety for all purposes.

Many of the methods and systems disclosed herein utilize enzyme activities. A variety of enzymes are well known, have been characterized and many are commercially available from one or more supplier. For a review of enzyme activities commonly used in molecular biology see, for example, Rittie and Perbal, *J. Cell Commun. Signal.* (2008) 2:25-45, incorporated herein by reference in its entirety. Exemplary enzymes include DNA dependent DNA polymerases (such as those shown in Table 1 of Rittie and Perbal), RNA dependent DNA polymerase (see Table 2 of Rittie and Perbal), RNA polymerases, ligases (see Table 3 of Rittie and Perbal), enzymes for phosphate transfer and removal (see Table 4 of Rittie and Perbal), nucleases (see Table 5 of Rittie and Perbal), and methylases.

Other methods of genome analysis and complexity reduction include, for example, AFLP, see U.S. Pat. No. 6,045,994, which is incorporated herein by reference, and arbitrarily primed-PCR (AP-PCR) see McClelland and Welsh, in *PCR Primer: A laboratory Manual*, (1995) eds. C. Dieffenbach and G. Dveksler, Cold Spring Harbor Lab Press, for example, at p 203, which is incorporated herein by reference in its entirety. Additional methods of sample preparation and techniques for reducing the complexity of a nucleic sample are described in Dong et al., *Genome Research* 11, 1418 (2001), in U.S. Pat. Nos. 6,361,947, 6,391,592, 6,458,530 and U.S. Patent Publication Nos. 20030039069, 20050079536, 20030096235, 20030082543, 20040072217, 20050142577, 20050233354, 20050227244, 20050208555, 20050074799, 20050042654 and 20040067493, which are each incorporated herein by reference in their entireties.

The design and use of allele-specific probes for analyzing polymorphisms is described by e.g., Saiki et al., *Nature* 324, 163-166 (1986); Dattagupta, EP 235,726, and WO 89/11548. Allele-specific probes can be designed that hybridize to a segment of target DNA from one individual but do not hybridize to the corresponding segment from another individual due to the presence of different polymorphic forms in the respective segments from the two individuals.

Sample preparation methods are also contemplated in many embodiments. Prior to or concurrent with analysis, the genomic sample may be amplified by a variety of mechanisms, some of which may employ PCR. See, e.g., *PCR Technology: Principles and Applications for DNA Amplification* (Ed. H. A. Erlich, Freeman Press, NY, NY, 1992); *PCR Protocols: A Guide to Methods and Applications* (Eds. Innis, et al., Academic Press, San Diego, C A, 1990); Mattila et al., *Nucleic Acids* Res. 19, 4967 (1991); Eckert et al., *PCR Methods and Applications* 1, 17 (1991); PCR (Eds. McPherson et al., IRL Press, Oxford); and U.S. Pat. Nos. 4,683,202, 4,683,195, 4,800,159 4,965,188, and 5,333,675, and each of which is incorporated herein by reference in their entireties for all purposes. See also U.S. Pat. No. 6,300,070 which is incorporated herein by reference. Additional methods of sample preparation and techniques for reducing the complexity of a nucleic sample are described in Dong et al., *Genome Research* 11, 1418 (2001), in U.S. Pat. Nos. 6,361,947, 6,391,592 and U.S. Patent Pub. Nos. 20030096235, 20030082543 and 20030036069.

Other suitable amplification methods include the ligase chain reaction (LCR) (for example, Wu and Wallace, *Genomics* 4, 560 (1989), Landegren et al., *Science* 241, 1077 (1988) and Barringer et al. *Gene* 89:117 (1990)), transcription amplification (Kwoh et al., *Proc. Natl. Acad. Sci. USA* 86, 1173 (1989) and WO88/10315), self-sustained sequence replication (Guatelli et al., *Proc. Nat. Acad. Sci. USA*, 87, 1874 (1990) and WO90/06995), selective amplification of target polynucleotide sequences (U.S. Pat. No. 6,410,276), consensus sequence primed polymerase chain reaction (CP-PCR) (U.S. Pat. No. 4,437,975), arbitrarily primed polymerase chain reaction (AP-PCR) (U.S. Pat. Nos. 5,413,909, 5,861,245), rolling circle amplification (RCA) (for example, Fire and Xu, PNAS 92:4641 (1995) and Liu et al., J. Am. Chem. Soc. 118:1587 (1996)) and nucleic acid based sequence amplification (NABSA). (See, U.S. Pat. Nos. 5,409,818, 5,554,517, and 6,063,603, each of which is incorporated herein by reference). Other amplification methods that may be used are described in, U.S. Pat. Nos.

6,582,938, 5,242,794, 5,494,810, 4,988,617, and US Pub. No. 20030143599 each of which is incorporated herein by reference.

Molecular inversion probes may also be used for amplification of selected targets. MIPs may be generated so that the ends of the pre-circle probe are complementary to regions that flank the region to be amplified. The gap can be closed by extension of the end of the probe so that the complement of the target is incorporated into the MIP prior to ligation of the ends to form a closed circle. The closed circle can be amplified as previously disclosed in Hardenbol et al., Genome Res. 15:269-275 (2005) and in U.S. Pat. No. 6,858,412.

In some embodiments, amplification may include the use of a strand displacing polymerase that may be primed by selected primers or by a mixture of primers, for example, random hexamers. See for example Lasken and Egholm, *Trends Biotechnol.* 2003 21(12):531-5; Barker et al. *Genome Res.* 2004 May; 14(5):901-7; Dean et al. *Proc Natl Acad Sci USA.* 2002; 99(8):5261-6; and Paez, J. G., et al. *Nucleic Acids Res.* 2004; 32(9):e71. Other amplification methods that may be used include: Qbeta Replicase, described in PCT Patent Application No. PCT/US87/00880, isothermal amplification methods such as SDA, described in Walker et al. 1992, Nucleic Acids Res. 20(7):1691-6, 1992, and rolling circle amplification, described in U.S. Pat. No. 5,648,245. DNA may also be amplified by multiplex locus-specific PCR or using adaptor-ligation and single primer PCR. Other available methods of amplification, such as balanced PCR (Makrigiorgos, et al. (2002), *Nat Biotechnol*, Vol. 20, pp. 936-9), may also be used.

Methods of ligation will be known to those of skill in the art and are described, for example in Sambrook et at. (2001) and the New England BioLabs catalog both of which are incorporated herein by reference for all purposes. Methods include using T4 DNA Ligase which catalyzes the formation of a phosphodiester bond between juxtaposed 5' phosphate and 3' hydroxyl termini in duplex DNA or RNA with blunt and sticky ends; Taq DNA Ligase which catalyzes the formation of a phosphodiester bond between juxtaposed 5' phosphate and 3' hydroxyl termini of two adjacent oligonucleotides which are hybridized to a complementary target DNA; *E. coli* DNA ligase which catalyzes the formation of a phosphodiester bond between juxtaposed 5'-phosphate and 3'-hydroxyl termini in duplex DNA containing cohesive ends; and T4 RNA ligase which catalyzes ligation of a 5' phosphoryl-terminated nucleic acid donor to a 3' hydroxyl-terminated nucleic acid acceptor through the formation of a 3'→5' phosphodiester bond, substrates include single-stranded RNA and DNA as well as dinucleoside pyrophosphates; or any other methods described in the art. Fragmented DNA may be treated with one or more enzymes, for example, an endonuclease, prior to ligation of adaptors to one or both ends to facilitate ligation by generating ends that are compatible with ligation.

Fixed content mapping arrays are available from Affymetrix, for example, the SNP 6.0 array. Methods for using mapping arrays see, for example, Kennedy et al., *Nat. Biotech.* 21:1233-1237 (2003), Matsuzaki et al., *Genome Res.* 14:414-425 (2004), Matsuzaki et al., *Nat. Meth.* 1:109-111 (2004) and U.S. Patent Pub. Nos. 20040146890 and 20050042654, each incorporated herein by reference. Applications of microarrays for SNP genotyping have been described in e.g., U.S. Pat. Nos. 6,300,063, 6,361,947, 6,368,799 and US Patent Publication Nos. 20040067493, 20030232353, 20030186279, 20050260628, 20070065816 and 20030186280, all incorporated herein by reference in their entireties for all purposes.

Selected panels of SNPs can also be interrogated using a panel of locus specific probes in combination with a universal array as described in Hardenbol et al., *Genome Res.* 15:269-275 (2005) and in U.S. Pat. No. 6,858,412. Universal tag arrays and reagent kits for performing such locus specific genotyping using panels of custom molecular inversion probes (MIPs) are available from Affymetrix.

Computer implemented methods for determining genotype using data from mapping arrays are disclosed, for example, in Liu, et al., *Bioinformatics* 19:2397-2403 (2003), Rabbee and Speed, *Bioinformatics,* 22:7-12 (2006), and Di et al., *Bioinformatics* 21:1958-63 (2005). Computer implemented methods for linkage analysis using mapping array data are disclosed, for example, in Ruschendorf and Nurnberg, *Bioinformatics* 21:2123-5 (2005) and Leykin et al., *BMC Genet.* 6:7, (2005). Computer methods for analysis of genotyping data are also disclosed in U.S. Patent Pub. Nos. 20060229823, 20050009069, 20040138821, 20060024715, 20050250151 and 20030009292.

Methods for analyzing chromosomal copy number using mapping arrays are disclosed, for example, in Bignell et al., *Genome Res.* 14:287-95 (2004), Lieberfarb, et al., *Cancer Res.* 63:4781-4785 (2003), Zhao et al., *Cancer Res.* 64:3060-71 (2004), Huang et al., *Hum Genomics* 1:287-299 (2004), Nannya et al., *Cancer Res.* 65:6071-6079 (2005), Slater et al., *Am. J. Hum. Genet.* 77:709-726 (2005) and Ishikawa et al., *Biochem. and Biophys. Res. Comm.,* 333: 1309-1314 (2005). Computer implemented methods for estimation of copy number based on hybridization intensity are disclosed in U.S. Patent Pub. Nos. 20040157243, 20050064476, 20050130217, 20060035258, 20060134674 and 20060194243.

Additional methods of sample preparation and techniques for reducing the complexity of a nucleic sample are described in Dong et al., *Genome Research* 11, 1418 (2001), in U.S. Pat. Nos. 6,361,947, 6,391,592 and 6,872,529 and U.S. Patent Publication Nos. 20030036069, 20030096235 and 20030082543. Additional methods of using a genotyping array are disclosed, for example, in U.S. Patent Publication Nos. 20040146883, 20030186280, 20030186279, 20040067493, 20030232353, 20060292597, 20050233354, 20050074799, 20070065816 and 20040185475.

Methods for conducting polynucleotide hybridization assays have been well developed in the art. Hybridization assay procedures and conditions will vary depending on the application and are selected in accordance with known general binding methods, including those referred to in: Maniatis et al. *Molecular Cloning: A Laboratory Manual* ($2_{nd}$ Ed. Cold Spring Harbor, N.Y, 1989); Berger and Kimmel *Methods in Enzymology*, Vol. 152*, Guide to Molecular Cloning Techniques* (Academic Press, Inc., San Diego, C A, 1987); Young and Davis, *P.N.A.S,* 80: 1194 (1983). Methods and apparatus for carrying out repeated and controlled hybridization reactions have been described in U.S. Pat. Nos. 5,871,928, 5,874,219, 6,045,996 and 6,386,749, 6,391, 623 each of which are incorporated herein by reference.

The present invention also contemplates signal detection of hybridization between ligands in certain preferred embodiments. See U.S. Pat. Nos. 5,143,854, 5,578,832, 5,631,734, 5,834,758, 5,936,324, 5,981,956, 6,025,601, 6,141,096, 6,185,030, 6,201,639, 6,218,803, and 6,225,625 in U.S. Patent Pub. No. 20040012676 and in PCT Application PCT/US99/06097 (published as WO99/47964), each of which also is hereby incorporated by reference in its entirety for all purposes.

Methods and apparatus for signal detection and processing of intensity data are disclosed in, for example, U.S. Pat. Nos. 5,143,854, 5,547,839, 5,578,832, 5,631,734, 5,800,992, 5,834,758, 5,856,092, 5,902,723, 5,936,324, 5,981,956; 6,025,601, 6,090,555, 6,141,096, 6,185,030, 6,201,639; 6,218,803; and 6,225,625, in U.S. Patent Pub. Nos. 20040012676 and 20050059062 and in PCT Application PCT/US99/06097 (published as WO99/47964), each of which also is hereby incorporated by reference in its entirety for all purposes.

The practice of the present invention may also employ conventional biology methods, software and systems. Computer software products of the invention typically include computer readable medium having computer-executable instructions for performing the logic steps of the method of the invention. Suitable computer readable medium include floppy disk, CD-ROM/DVD/DVD-ROM, hard-disk drive, flash memory, ROM/RAM, magnetic tapes, etc. The computer-executable instructions may be written in a suitable computer language or combination of several languages. Basic computational biology methods are described in, for example, Setubal and Meidanis et al., *Introduction to Computational Biology Methods* (PWS Publishing Company, Boston, 1997); Salzberg, Searles, Kasif, (Ed.), *Computational Methods in Molecular Biology*, (Elsevier, Amsterdam, 1998); Rashidi and Buehler, *Bioinformatics Basics: Application in Biological Science and Medicine* (CRC Press, London, 2000) and Ouelette and Bzevanis *Bioinformatics: A Practical Guide for Analysis of Gene and Proteins* (Wiley & Sons, Inc., $2^{nd}$ ed., 2001). See U.S. Pat. No. 6,420,108.

The present invention may also make use of various computer program products and software for a variety of purposes, such as probe design, management of data, analysis, and instrument operation. See, U.S. Pat. Nos. 5,593,839, 5,795,716, 5,733,729, 5,974,164, 6,066,454, 6,090,555, 6,185,561, 6,188,783, 6,223,127, 6,229,911 and 6,308,170. Computer methods related to genotyping using high density microarray analysis may also be used in the present methods, see, for example, US Patent Pub. Nos. 20050250151, 20050244883, 20050108197, 20050079536 and 20050042654.

Additionally, the present disclosure may have preferred embodiments that include methods for providing genetic information over networks such as the Internet as shown in U.S. Patent Pub. Nos. 20030097222, 20020183936, 20030100995, 20030120432, 20040002818, 20040126840, and 20040049354.

An allele refers to one specific form of a genetic sequence (such as a gene) within a cell, an individual or within a population, the specific form differing from other forms of the same gene in the sequence of at least one, and frequently more than one, variant sites within the sequence of the gene. The sequences at these variant sites that differ between different alleles are termed "variances", "polymorphisms", or "mutations". At each autosomal specific chromosomal location or "locus" an individual possesses two alleles, one inherited from one parent and one from the other parent, for example one from the mother and one from the father. An individual is "heterozygous" at a locus if it has two different alleles at that locus. An individual is "homozygous" at a locus if it has two identical alleles at that locus.

Single nucleotide polymorphisms (SNPs) are positions at which two alternative bases occur at appreciable frequency (>1%) in a given population. SNPs are a common type of human genetic variation and are useful in the performance of genome wide association studies (GWAS). GWAS may be used, for example for the analysis of biological pathways, see Wang and Hakonarson, Nat. Rev. Genet. 2010, 11:843-854. Other common variation includes single base deletions or insertions of a nucleotide relative to a reference allele. Copy number variants (CNVs), transversions and other rearrangements are also forms of genetic variation.

The term genotyping refers to the determination of the genetic information an individual carries at one or more positions in the genome. For example, genotyping may comprise the determination of which allele or alleles an individual carries for a single SNP or the determination of which allele or alleles an individual carries for a plurality of SNPs or CNVs. A diploid individual may be homozygous for each of the two possible alleles (for example, AA or BB) or heterozygous (for example, AB). For additional information regarding genotyping and genome structure see, *Color Atlas of Genetics*, Ed. Passarge, Thieme, New York, NY (2001), which is incorporated by reference.

Normal cells that are heterozygous at one or more loci may give rise to tumor cells that are homozygous at those loci. This loss of heterozygosity (LOH) may result from structural deletion of normal genes or loss of the chromosome carrying the normal gene, mitotic recombination between normal and mutant genes, followed by formation of daughter cells homozygous for deleted or inactivated (mutant) genes; or loss of the chromosome with the normal gene and duplication of the chromosome with the deleted or inactivated (mutant) gene.

The term "array" as used herein refers to an intentionally created collection of molecules which can be prepared either synthetically or biosynthetically. The molecules in the array can be identical or different from each other. The array can assume a variety of formats, for example, libraries of soluble molecules; libraries of compounds tethered to resin beads, silica chips, microparticles, nanoparticles or other solid supports.

The term "complementary" as used herein refers to the hybridization or base pairing between nucleotides or nucleic acids, such as, for instance, between the two strands of a double stranded DNA molecule or between an oligonucleotide primer and a primer binding site on a single stranded nucleic acid to be sequenced or amplified. See, M. Kanehisa Nucleic Acids Res. 12:203 (1984), incorporated herein by reference.

The term "copy number variation" or "CNV" refers to differences in the copy number of genetic information. In many aspects it refers to differences in the per genome copy number of a genomic region. For example, in a diploid organism the expected copy number for autosomal genomic regions is 2 copies per genome. Such genomic regions should be present at 2 copies per cell. For a recent review see Zhang et al. *Annu. Rev. Genomics Hum. Genet.* 2009. 10:451-81. CNV is a source of genetic diversity in humans and can be associated with complex disorders and disease, for example, by altering gene dosage, gene disruption, or gene fusion. They can also represent benign polymorphic variants. CNVs can be large, for example, larger than 1 Mb, but many are smaller, for example between 100 bp and 1 Mb. More than 38,000 CNVs greater than 100 bp (and less than 3 Mb) have been reported in humans. Along with SNPs these CNVs account for a significant amount of phenotypic variation between individuals. In adition to having deleterious impacts, e.g. causing disease, they may also result in advantageous variation.

Digital PCR is a technique where a limiting dilution of the sample is made across a large number of separate PCR reactions so that most of the reactions have no template molecules and give a negative amplification result. Those reactions that are positive at the reaction endpoint are counted as individual template molecules present in the original sample in a 1 to 1 relationship. See Kalina et al. NAR 25:1999-2004 (1997) and Vogelstein and Kinzler, PNAS 96:9236-9241 (1999). This method is an absolute counting method where solutions are partitioned into containers until there is an average probability of one molecule per two containers or when, $P_0=(1-e^{-n/c})=\frac{1}{2}$; where n is the number of molecules and c is the number of containers, or n/c is 0.693. Quantitative partitioning is assumed, and the dynamic range is governed by the number of containers available for stochastic separation. The molecules are then detected by PCR and the number of positive containers is counted. Each successful amplification is counted as one molecule, independent of the actual amount of product. PCR-based techniques have the additional advantage of only counting molecules that can be amplified, e.g. that are relevant to the massively parallel PCR step in the sequencing workflow. Because digital PCR has single molecule sensitivity, only a few hundred library molecules are required for accurate quantification. Elimination of the quantification bottleneck reduces the sample input requirement from micrograms to nanograms or less, opening the way for minute and/or precious samples onto the next-generation sequencing platforms without the distorting effects of pre-amplification. Digital PCR has been used to quantify sequencing libraries to eliminate uncertainty associated with the construction and application of standard curves to PCR-based quantification and enable direct sequencing without titration runs. See White et al. *BMC Genomics* 10: 116 (2009).

To vary dynamic range, micro-fabrication can be used to substantially increase the number of containers. See, Fan et al. *Am J Obstet Gynecol* 200, 543 e1 (May, 2009).

Similarly, in stochastic labeling as disclosed herein, the same statistical conditions are met when $P_0=(1-e^{-n/m})=\frac{1}{2}$; where m is the number of labels, and one half of the labels will be used at least once when n/m=0.693. The dynamic range is governed by the number of labels used, and the number of labels can be easily increased to extend the dynamic range. The number of containers in digital PCR plays the same role as the number of labels in stochastic labeling and by substituting containers for labels identical statistical equations may be applied. Using the principles of physical separation, digital PCR stochastically expands identical molecules into physical space, whereas the principle governing stochastic labeling is identity based and expands identical molecules into identity space.

The term "hybridization" as used herein refers to the process in which two single-stranded polynucleotides bind noncovalently to form a stable double-stranded polynucleotide; triple-stranded hybridization is also theoretically possible. The resulting (usually) double-stranded polynucleotide is a "hybrid." The proportion of the population of polynucleotides that forms stable hybrids is referred to herein as the "degree of hybridization." Hybridizations may be performed under stringent conditions, for example, at a salt concentration of no more than 1 M and a temperature of at least 25° C. For example, conditions of 5×SSPE (750 mM NaCl, 50 mM NaPhosphate, 5 mM EDTA, pH 7.4) and a temperature of 25-30° C. are suitable for allele-specific probe hybridizations. For stringent conditions, see, for example, Sambrook, Fritsche and Maniatis. "Molecular Cloning A laboratory Manual" 2nd Ed. Cold Spring Harbor Press (1989) which is hereby incorporated by reference in its entirety for all purposes above. In some aspects salt concentrations for hybridization are preferably between about 200 mM and about 1M or between about 200 mM and about 500 mM. Hybridization temperatures can be as low as 5° C., but are typically greater than 22° C., more typically greater than about 30° C., and preferably in excess of about 37° C. Longer fragments may require higher hybridization temperatures for specific hybridization. As other factors may affect the stringency of hybridization, including base composition and length of the complementary strands, presence of organic solvents and extent of base mismatching, the combination of parameters is more important than the absolute measure of any one alone.

The term "mRNA" or sometimes refer by "mRNA transcripts" as used herein, include, but not limited to pre-mRNA transcript(s), transcript processing intermediates, mature mRNA(s) ready for translation and transcripts of the gene or genes, or nucleic acids derived from the mRNA transcript(s). Transcript processing may include splicing, editing and degradation. As used herein, a nucleic acid derived from an mRNA transcript refers to a nucleic acid for whose synthesis the mRNA transcript or a subsequence thereof has ultimately served as a template. Thus, a cDNA reverse transcribed from an mRNA, an RNA transcribed from that cDNA, a DNA amplified from the cDNA, an RNA transcribed from the amplified DNA, etc., are all derived from the mRNA transcript and detection of such derived products is indicative of the presence and/or abundance of the original transcript in a sample. Thus, mRNA derived samples include, but are not limited to, mRNA transcripts of the gene or genes, cDNA reverse transcribed from the mRNA, cRNA transcribed from the cDNA, DNA amplified from the genes, RNA transcribed from amplified DNA, and the like.

The term "nucleic acid" as used herein refers to a polymeric form of nucleotides of any length, either ribonucleotides, deoxyribonucleotides or peptide nucleic acids (PNAs), that comprise purine and pyrimidine bases, or other natural, chemically or biochemically modified, non-natural, or derivatized nucleotide bases. The backbone of the polynucleotide can comprise sugars and phosphate groups, as may typically be found in RNA or DNA, or modified or substituted sugar or phosphate groups. A polynucleotide may comprise modified nucleotides, such as methylated nucleotides and nucleotide analogs. The sequence of nucleotides may be interrupted by non-nucleotide components. Thus the terms nucleoside, nucleotide, deoxynucleoside and deoxynucleotide generally include analogs such as those described herein. These analogs are those molecules having some structural features in common with a naturally occurring nucleoside or nucleotide such that when incorporated into a nucleic acid or oligonucleoside sequence, they allow hybridization with a naturally occurring nucleic acid sequence in solution. Typically, these analogs are derived from naturally occurring nucleosides and nucleotides by replacing and/or modifying the base, the ribose or the phosphodiester moiety. The changes can be tailor made to stabilize or destabilize hybrid formation or enhance the specificity of hybridization with a complementary nucleic acid sequence as desired.

The term "oligonucleotide" or sometimes refer by "polynucleotide" as used herein refers to a nucleic acid ranging from at least 2, preferable at least 8, and more preferably at least 20 nucleotides in length or a compound that specifically hybridizes to a polynucleotide. Polynucleotides of the present invention include sequences of deoxyribonucleic acid (DNA) or ribonucleic acid (RNA) which may be isolated from natural sources, recombinantly produced or artificially synthesized and mimetics thereof. A further example of a polynucleotide of the present invention may be peptide nucleic acid (PNA). The invention also encompasses situations in which there is a nontraditional base pairing such as Hoogsteen base pairing which has been identified in certain tRNA molecules and postulated to exist in a triple helix. "Polynucleotide" and "oligonucleotide" are used interchangeably in this application.

The term "polymorphism" as used herein refers to the occurrence of two or more genetically determined alternative sequences or alleles in a population. A polymorphic marker or site is the locus at which divergence occurs. Preferred markers have at least two alleles, each occurring at frequency of greater than 1%, and more preferably greater than 10% or 20% of a selected population. A polymorphism may comprise one or more base changes, an insertion, a repeat, or a deletion. A polymorphic locus may be as small as one base pair. Polymorphic markers include restriction fragment length polymorphisms, variable number of tandem repeats (VNTR's), hypervariable regions, minisatellites, dinucleotide repeats, trinucleotide repeats, tetranucleotide repeats, simple sequence repeats, and insertion elements such as Alu. The first identified allelic form is arbitrarily designated as the reference form and other allelic forms are designated as alternative or variant alleles. The allelic form occurring most frequently in a selected population is sometimes referred to as the wildtype form. Diploid organisms may be homozygous or heterozygous for allelic forms. A diallelic polymorphism has two forms. A triallelic polymorphism has three forms. Single nucleotide polymorphisms (SNPs) are included in polymorphisms.

The term "primer" as used herein refers to a single-stranded oligonucleotide capable of acting as a point of initiation for template-directed DNA synthesis under suitable conditions for example, buffer and temperature, in the presence of four different nucleoside triphosphates and an agent for polymerization, such as, for example, DNA or RNA polymerase or reverse transcriptase. The length of the primer, in any given case, depends on, for example, the intended use of the primer, and generally ranges from 15 to 30 nucleotides. Short primer molecules generally require cooler temperatures to form sufficiently stable hybrid complexes with the template. A primer need not reflect the exact sequence of the template but must be sufficiently complementary to hybridize with such template. The primer site is the area of the template to which a primer hybridizes. The primer pair is a set of primers including a 5' upstream primer that hybridizes with the 5' end of the sequence to be amplified and a 3' downstream primer that hybridizes with the complement of the 3' end of the sequence to be amplified.

The term "probe" as used herein refers to a surface-immobilized molecule that can be recognized by a particular target. See U.S. Pat. No. 6,582,908 for an example of arrays having all possible combinations of probes with 10, 12, and more bases. Examples of probes that can be investigated by this invention include, but are not restricted to, agonists and antagonists for cell membrane receptors, toxins and venoms, viral epitopes, hormones (for example, opioid peptides, steroids, etc.), hormone receptors, peptides, enzymes, enzyme substrates, cofactors, drugs, lectins, sugars, oligonucleotides, nucleic acids, oligosaccharides, proteins, and monoclonal antibodies.

The term "solid support", "support", and "substrate" as used herein are used interchangeably and refer to a material or group of materials having a rigid or semi-rigid surface or surfaces. In many embodiments, at least one surface of the solid support will be substantially flat, although in some embodiments it may be desirable to physically separate synthesis regions for different compounds with, for example, wells, raised regions, pins, etched trenches, or the like. According to other embodiments, the solid support(s) will take the form of beads, resins, gels, microspheres, or other geometric configurations. See U.S. Pat. No. 5,744,305 and US Patent Pub. Nos. 20090149340 and 20080038559 for exemplary substrates.

A stochastic process is the counterpart to a deterministic process. Instead of dealing with only one possible "reality" of how the process might evolve under time, in a stochastic or random process there is some indeterminacy in its future evolution described by probability distributions. This means that even if the initial condition (or starting point) is known, there are many possibilities the process might go to, but some paths are more probable and others less.

In the simplest possible case, a stochastic process amounts to a sequence of random variables known as a time series (for example, see Markov chain). Another basic type of a stochastic process is a random field, whose domain is a region of space, in other words, a random function whose arguments are drawn from a range of continuously changing values. One approach to stochastic processes treats them as functions of one or several deterministic arguments ("inputs", in most cases regarded as "time") whose values ("outputs") are random variables: non-deterministic (single) quantities which have certain probability distributions. Random variables corresponding to various times (or points, in the case of random fields) may be completely different. The main requirement is that these different random quantities all have the same "type". Although the random values of a stochastic process at different times may be independent random variables, in most commonly considered situations they exhibit complicated statistical correlations.

Familiar examples of processes modeled as stochastic time series include stock market and exchange rate fluctuations, signals such as speech, audio and video, medical data such as a patient's EKG, EEG, blood pressure or temperature, and random movement such as Brownian motion or random walks. Examples of random fields include static images, random terrain (landscapes), or composition variations of an heterogeneous material.

The stochastic labeling process can be generalized as follows. Consider n copies of a given target molecule T, where $T=\{t1, i=1,2, \ldots, n\}$, and a non-depleting reservoir of m diverse labels L, where $L=\{l_j, j=1,2, \ldots, m\}$. T reacts with L stochastically, such that each $t_i$ will choose exactly one $l_{j(i)}$, $1 \leq j(i) \leq m$ to take on a new identity $t_i l_{j(i)}$, and may be identified by its label subscript. Therefore, the new collection of molecules T* may be denoted as $T^*=\{tl_{j(i)}, i=1,2, \ldots, n, 1 \leq j(i) \leq m\}$.

When different copies of the target molecules react with the same label, j(i) for those molecules will assume the same value, therefore, the number of uniquely labeled target molecules k cannot be greater than m. The stochastic mapping of the set of labels on a target may be described by a stochastic operator S with m members, acting upon a target population of n, such that $S(m)T(n)=T^*(m,n)$ generating the set $T^*=\{tl_{j(i)}, i=1,2, \ldots, n, 1 \leq j(i) \approx m\}$. For simplicity, we may write $T^*=\{tl_k\}$. Furthermore, since S operates on all molecules randomly, it will independently act on many different target sequences and the method can be expanded to count copies of multiple target sequences, w, simultaneously: $ST^w=ST_1+ST_2+ \ldots +ST_w=T_1^*+T_2^*+ \ldots +T_w^*=\{tl_k\}_1+ \ldots +\{tl_k\}_2+ \ldots +\{tl_k\}_w$, where each $T_i^*$, $i=1,2, \ldots, w$ consists of a set $\{tl_k\}_i$. The net result of S operating on a specific target population is to map the number of molecules, n, of that target, to the number of labels captured, k, which is a random variable.

Since target molecules randomly react with a label with probability $$\frac{1}{m},$$

the probability of a label being captured by exactly x out of n copies of a target molecule can be modeled as a Binomial distribution, $$P(x) = \frac{n!}{x!(n-x)!}\left(\frac{1}{m}\right)^x\left(1-\frac{1}{m}\right)^{n-x},$$

where x! denotes the factorial of x. The probability that a label will not be captured by any copy of the target molecule is $P(0)=(1-1/m)^n$, and the probability that a label will be captured at least once is $1-P(0)$. When $n\to\infty$ and $1/m\to0$ in the way that $n/m\to\lambda$, $P(x)$ converges to the Poisson distribution with mean $\lambda$, i.e., $$P(x) = \frac{\lambda^x}{x!}e^{-\lambda}.$$

To compute the number of unique labels captured by n copies of a target molecule, we introduce an index random variable, $X_i$, which is 1 if a label has been captured at least once, and 0 otherwise. The number of unique labels captured is thus $$k = \sum_{i=1}^{m} X_i.$$

The mean and variance of k can be derived, $$E[k] = m\left[1-\left(1-\frac{1}{m}\right)^n\right] \quad (1)$$

$$\text{Var}[k] = m\left[1-\left(1-\frac{1}{m}\right)^n\right]\left(1-\frac{1}{m}\right)^n + m(m-1)\left[\left(1-\frac{2}{m}\right)^n - \left(1-\frac{1}{m}\right)^{2n}\right] \quad (2)$$

Similarly, to compute the number of labels captured by exactly x copies of a target molecule, we introduce another index random variable, $Y_i$, which is 1 if a label has been captured exactly x times, and 0 otherwise. The number of labels captured x times is thus $$t = \sum_{i=1}^{m} Y_i.$$

The mean and variance of t are, $$E[t] = \frac{m \cdot n!}{x!(n-x)!}\left(\frac{1}{m}\right)^x\left(1-\frac{1}{m}\right)^{n-x} \quad (3)$$

$$\text{Var}[t] = A(1-A) + (m-1)m\cdot\binom{n}{2x}\cdot\left(\frac{2}{m}\right)^{2x}\left(1-\frac{2}{m}\right)^{n-2x}\binom{2x}{x}\left(\frac{1}{2}\right)^{2x} \quad (4)$$

where $$A = m\cdot\binom{n}{x}\left(\frac{1}{m}\right)^x\left(1-\frac{1}{m}\right)^{n-x},$$

and the combination $$\binom{n}{x} = \frac{n!}{x!(n-x)!}.$$

The equations were experimentally validated by performing numerical simulations with 5000 independent runs for each simulated case. Complete agreement with the analytical solutions was observed.

Stochastic Labeling of Individual Molecules

Methods are disclosed herein that may be applied to determining small numbers of biological molecules and their changes in response to, for example, cellular response, differentiation or signal transduction. The methods may also be used in performing a wide variety of clinical measurements. Although many analytical methods have been developed to measure the relative abundance of different molecules through sampling (e.g., microarrays and sequencing), the methods disclosed herein are able to determine the absolute number of molecules in a sample.

Figure 2A:
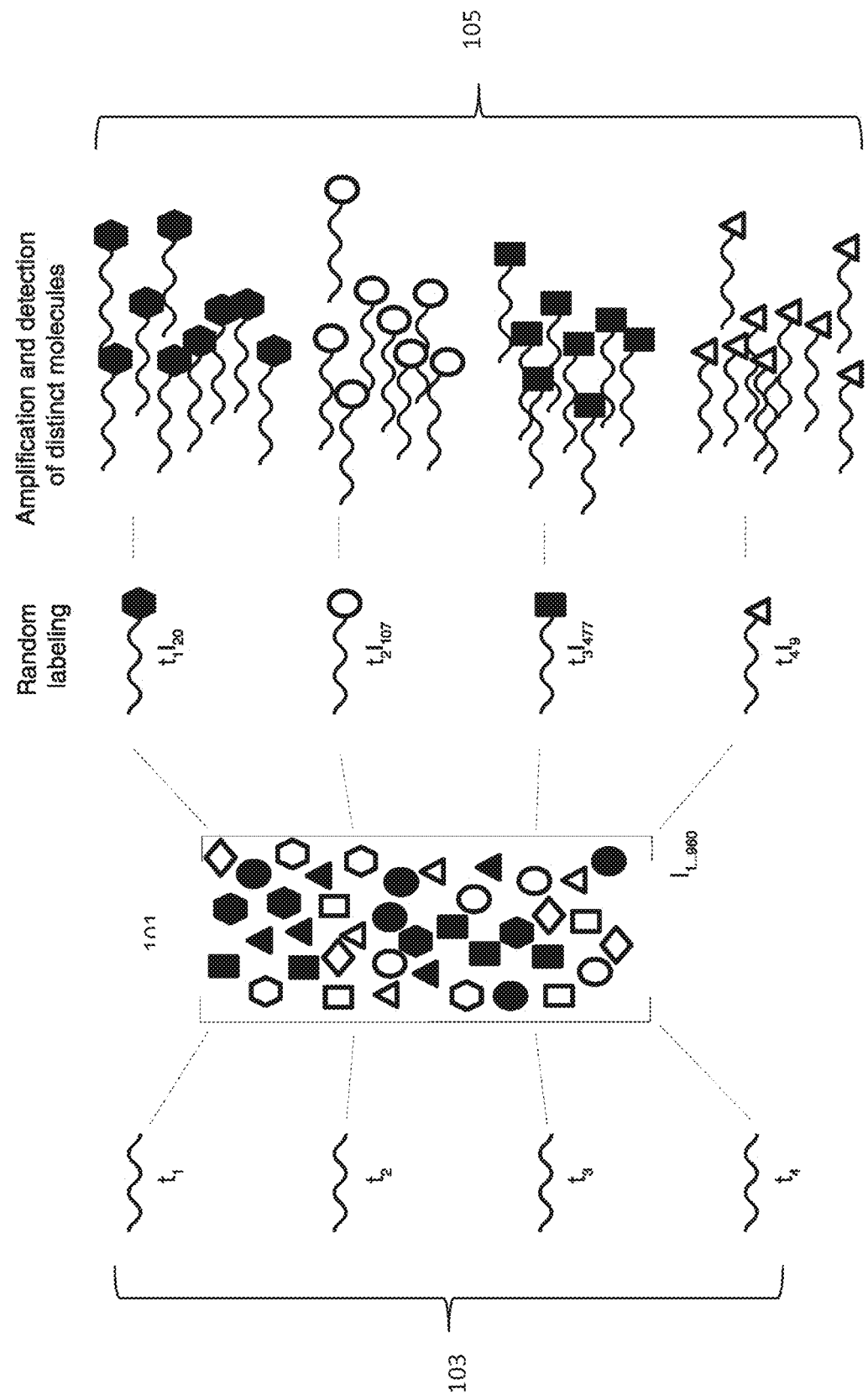
FIG. 2A shows a schematic of labeling target molecules with a pool of labels.

Methods for performing single molecule digital counting by the stochastic labeling of a collection of identical molecules are disclosed. As illustrated in FIGS. 1, 2A and 2B, each copy of a molecule (from a collection of identical target molecules 103) randomly captures a label by choosing from a large, non-depleting reservoir of diverse labels 101. The uniqueness of each labeled molecule is governed by the statistics of random choice, and depends on the number of copies of identical molecules in the collection compared to the diversity of labels. Once the molecules are labeled each has been given a unique identity and can now be separately detected. In some aspects, it is preferable to first amplify the labeled targets prior to detection so that simple present/absent threshold detection methods can be used. Counting the number of labels is used to determine the original number of molecules in solution. In some aspects, the molecules to be counted are each members of a class that shares some common feature, for example, they may each be a single copy of a particular gene sequence or nucleic acid sequence. Counting may be applied, for example, to mRNA targets, splice products, alternatively spliced products, structural RNAs, tRNA, miRNA, siRNA, microRNA and the like. Similarly, counting may be applied to DNA, for example, gene copy number, chromosome number, mitochondrial DNA, bacterial genomes, pathogen nucleic acid, viral nucleic acids and the like. Counting may be applied in research of disease in humans or other mammals or agricultural organisms, e.g. cattle, chicken, wheat, rice, fish, etc. Counting may also be applied to counting aspects of microbes, such as environmental measurements, e.g. water quality testing. The methods may be particularly useful where small numbers of items are to be counted and an accurate count is desirable rather than a relative estimate.

One embodiment is illustrated schematically in FIG. 1. The library of different label-tag sequences 101 is combined with a sample that includes an unknown number of targets of interest 103. Three different species of target are shown, 103a, 103b and 103c, present at 4, 6 and 3 copies respectively. The individual label-tag oligonucleotides from library 101 are covalently attached to the different targets to form target-label-tag molecules 105. Each target has a collection of different label-tag molecules 105a, 105b and 105c and within each target-specific collection the members differ in the label-tag oligo that is attached. On the array 107, each target is tiled in combination with all possible label-tag combinations represented with each different combination being present at a different known or determinable location on the array. In the figure each different possible combination of target and label-tag is represented by a single probe for illustration purposes, but on the array each different probe is preferably present in a feature having multiple copies of the same probe sequence. The array is divided into subarrays 107a, 107b and 107c for illustrative purposes. The upper portion 109 of the probes varies at each feature according to the different label-tag. The lower portion 113 is the same for all features of each subarray and is complementary to the target. After hybridization individual features of the array are labeled through hybridization of the complementary target-label-tag molecule to the feature. The figure shows a detectable label 111 may be used to detect features where a target-label-tag is hybridized.

FIG. 2A illustrates the attachment of different labels from the pool 101 to each of 4 different copies of the same target "t". Label 20 is attached to t1, label 107 to t2, label 477 to t3 and label 9 to t4. The labeled targets are then amplified to generate four unique populations, each population representing a single occurrence of the target in the starting sample.

FIG. 2B illustrates the method for a comparison of two samples, sample 1 and 2. The target 201 Gene A is present in 2 copies in sample 1 and 9 copies in sample 2. Both samples have non-target molecules 203. The labels 205 are combined with the samples and target molecules are attached to individual label-tag molecules in a stochastic manner. The targets with attached label-tags are hybridized to an array 211 having many features, there is a feature for each possible target-label-tag combination. Some of the features are labeled, for example, 209 and others are not, for example, 207. The labeled features indicate the presence of a specific target-label-tag combination and each corresponds to a count. As shown for gene A in sample 1 there are two labeled features so the count is 2. For Gene A in sample 2 there are 9 labeled features so the count is 9.

The stochastic labeling process can be generalized as follows for illustrative purposes. Consider a given target sequence defined as $T=\{t_1, t_2 \ldots tn\}$; where n is the number of copies of T. A set of labels is defined as $L=\{l_1, l_2 \ldots lm\}$; where m is the number of different labels. T reacts stochastically with L, such that each t becomes attached to one l. If the l's are in non-depleting excess, each t will choose one l randomly, and will take on a new identity $l_i t^j$; where $l_i$ is chosen from L and j is the $j^{th}$ copy from the set of n molecules. We identify each new molecule $l_i t_j$ by its label subscript and drop the subscript for the copies of T, because they are identical. The new collection of molecules becomes $T^*=l_1 t+l_2 t+ \ldots l_i t$; where $l_i$, is the $i^{th}$ choice from the set of m labels. It is important to emphasize that the subscripts of l at this point refer only to the $i^{th}$ choice and provide no information about the identity of each l. In fact, $l_1$ and $l_2$ will have some probability of being identical, depending upon the diversity m of the set of labels. Overall, T* will contain a set of k unique labels resulting from n targets choosing from the non-depleting reservoir of m labels. Or, $T^*(m,n)=\{tl_k\}$; where k represents the number of unique labels that have been captured. In all cases, k will be smaller than m, approaching m only when n becomes very large. We can define the stochastic attachment of the set of labels on a target using a stochastic operator S with m members, acting upon a target population of n, such that $S(m)T(n)=T^*(m,n)$ generating the set $\{tl_k\}$. Furthermore, since S operates on all molecules randomly, it can independently act on many different target sequences. Hence, the method can simultaneously count copies of multiple target sequences. The distribution of outcomes generated by the number of trials n, from a diversity of m, can be approximated by the Poisson equation, $P_x = ^x/x! e^{-(n/m)}$, $P_0$ is the probability that a label will not be chosen in n trials, and therefore, $1-P_0$ is the probability that a label will occur at least once. It follows that the number of unique labels captured is given by $k=m(1-P_0)=m(1-e^{-(n/m)})$.

Given k, we can calculate n. In addition to using the Poisson approximation, the relationship for k, n and m can be described analytically using the binomial distribution, or simulated using a random number generator, each yielding similar results (see SOM).

Figure 11:
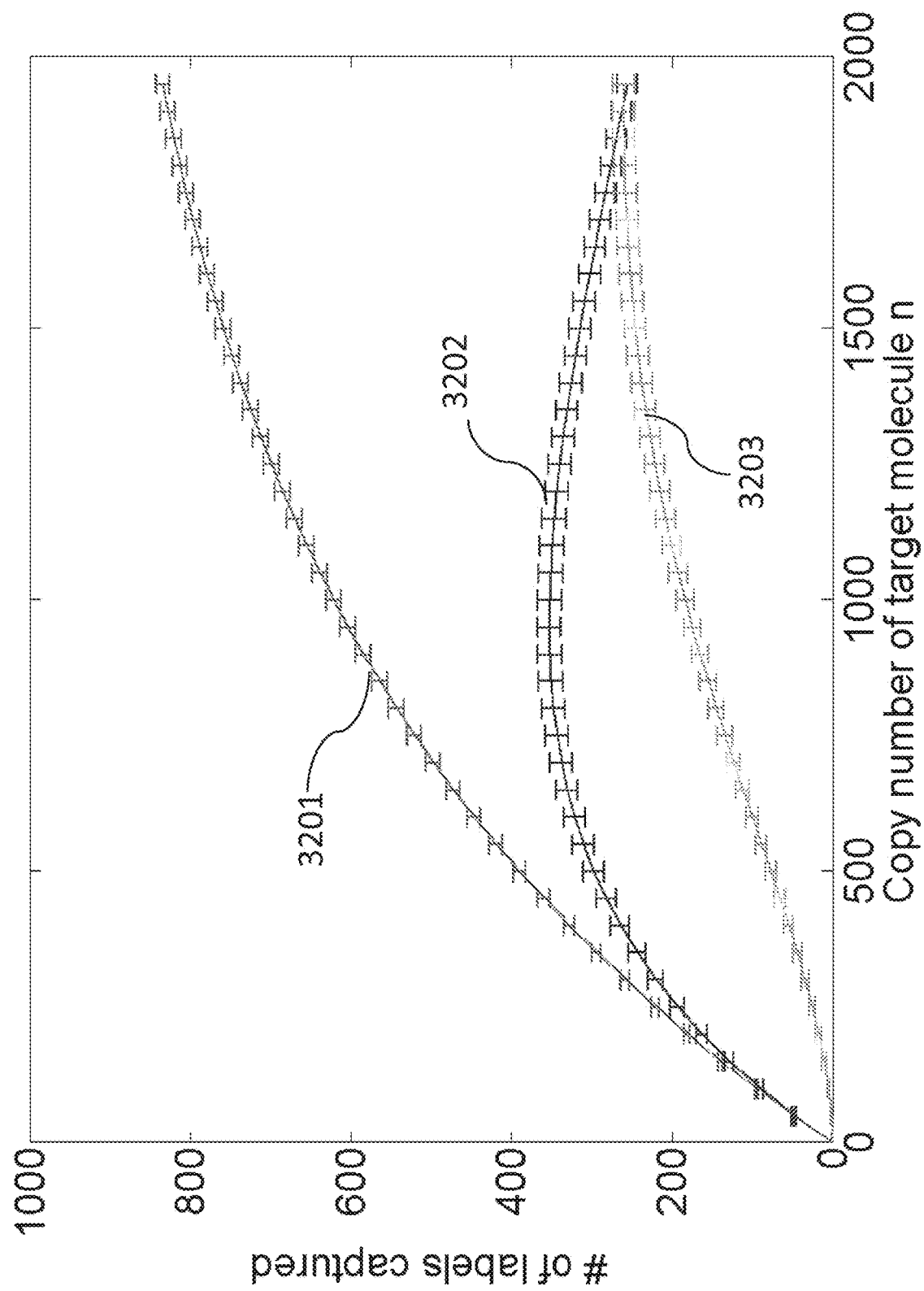
FIG. 11 is a plot of the number of labels from a non-depleting reservoir of 960 lables that are predicted to be captures at least once, exactly once or exactly twice.
Figure 15:
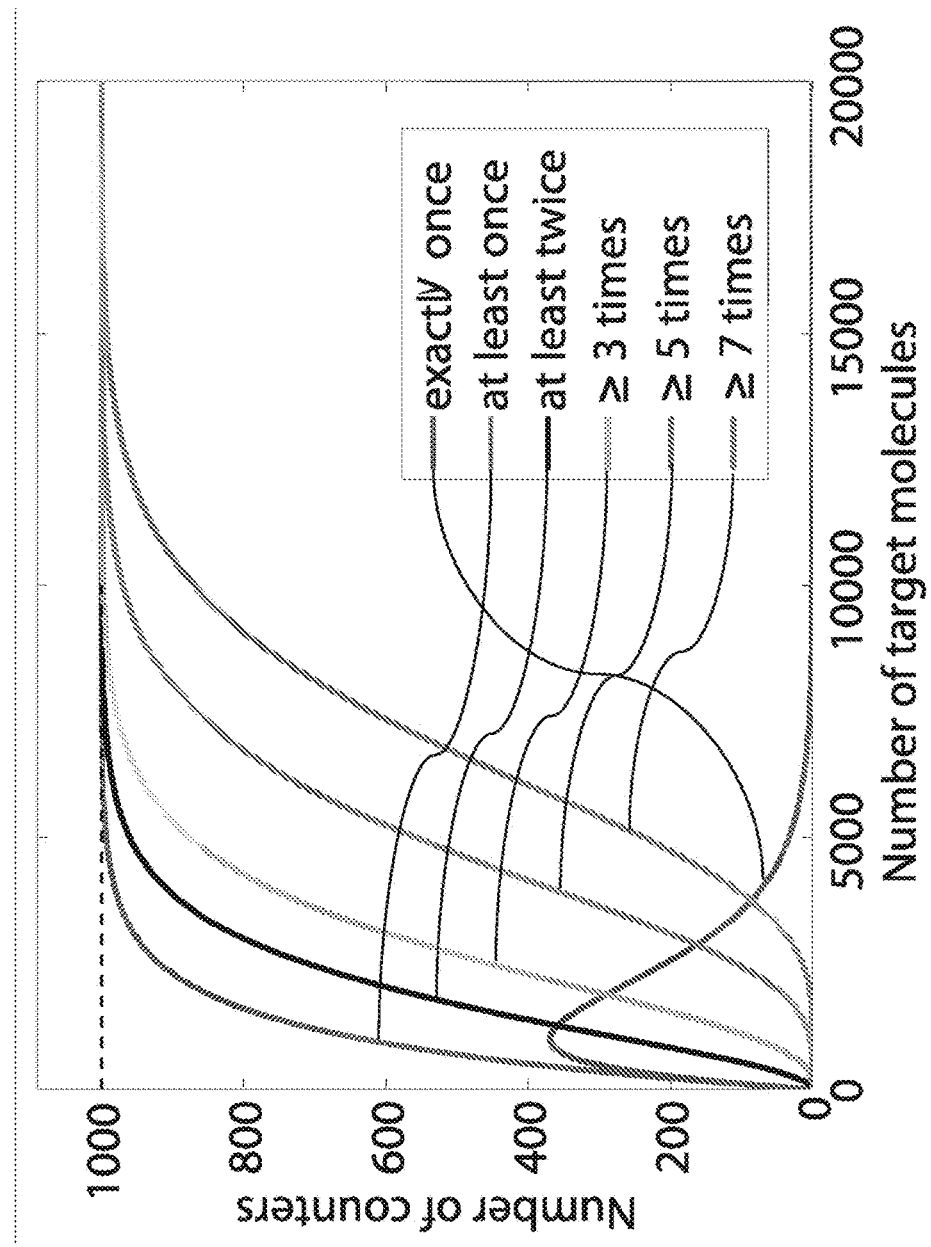
FIG. 15 shows a plot of the expected label usage (y-axis) when ligating to a given number of target molecules (x-axis).

The outcome of stochastic labeling is illustrated by examining the graph of k verses n (curve 3201 in FIG. 11) calculated using a label diversity (m) of 960. As expected, the number of unique labels captured depends on the ratio of molecules to labels, n/m. When n is much smaller than m, each molecule almost always captures a unique label, and counting k is equivalent to counting n. As n increases, k increases more slowly as given by eq. 1, and yet remains a very precise estimate of n. For example, when n/m is ~0.01, the ratio of unique labels to molecules k/n~0.99, and we expect an increase of 10 molecules will generate 10+/-X new labels. As n/m approaches 0.5 (i.e., ~480 molecules reacted with 960 labels), k/n~0.79 and ~6+/-X new labels are expected with an increase of 10 molecules. At high n/m, k increases more slowly as labels in the library are more likely to be captured more than once. Curve 3202 in FIG. 11 shows the number of labels chosen exactly once, and curve 3203 shows the number of labels chosen exactly twice as n increases. Curve 3201 shows the number of labels captured at least once. A more complete description of the number of times a label is chosen as a function of n is shown in FIG. 15.

The methods and examples below demonstrate that a population of indistinguishable molecules can be stochastically expanded to a population of uniquely identifiable and countable molecules. High-sensitivity threshold detection of single molecules is demonstrated, and the process can be used to count both the absolute and relative number of molecules in a sample. The method should be well suited for determining the absolute number of multiple target molecules in a specified container, for example in high-sensitivity clinical assays, or for determining the number of transcripts in single cells. The approach should also be compatible with other molecular assay systems. For example, antibodies could be stochastically labeled with DNA fragments and those that bind antigen harvested. After amplification, the number of labels detected will reflect the original number of antigens in solutions. In the examples shown here, DNA is used because of the great diversity of sequences available, and because it is easily detectable. In principle, any molecular label could be used, for example fluorescent groups or mass spectroscopy tags, as long as they are easily detected and they have sufficient diversity for the desired application. Although many of the examples refer to populations.

It is instructive to contrast the attributes of stochastic labeling with other quantitative methods. Microarray and sequencing technologies are commonly used to obtain relative abundance of multiple targets in a sample. In the case of microarray analysis, intensity values reflect the relative amount of hybridization bound target and can be used to compare to the intensity of other targets in the sample. In the case of sequencing, the relative number of times a sequence is found is compared to the number of times other sequences are found. Although the techniques differ by using intensity in one case and a digital count in the other, they both provide relative comparisons of the number of molecules in solution. In order to obtain absolute numbers, quantitative capture of all sequences would need to be assured; however in practice the efficiency of capture with microarray and sequencing technologies is unknown.

Digital PCR is an absolute counting method where solutions are stochastically partitioned into multi-well containers until there is an average probability of one molecule per two containers, then detected by PCR(4). This condition is satisfied when, $P_0=(1-e^{-n/c})=\frac{1}{2}$; where n is the number of molecules and c is the number of containers, or n/c is 0.693. Quantitative partitioning is assumed, and the dynamic range is governed by the number of containers available for stochastic separation. Once the molecules are partitioned, high efficiency PCR detection gives the yes/no answer and absolute counting enabled. To vary dynamic range, microfabrication can be used to substantially increase the number of containers (5). Similarly, in stochastic labeling, the same statistical conditions are met when $P_0=(1-e^{-n/m})=\frac{1}{2}$; where m is the number of labels, and one half of the labels will be used at least once when n/m=0.693. The dynamic range is governed by the number of labels used, and the number of labels can be easily increased to extend the dynamic range. The number of containers in digital PCR plays the same role as the number of labels in stochastic labeling and by substituting containers for labels we can write identical statistical equations. Using the principles of physical separation, digital PCR stochastically expands identical molecules into physical space, whereas the principle governing stochastic labeling is identity based and expands identical molecules into identity space.

New methods and compositions for single molecule counting employing the use of stochastic labeling are disclosed herein. In preferred aspects, a diverse set of labels is randomly attached to a population of identical molecules is converted into a population of distinct molecules suitable for threshold detection. Random attachment as used herein refers to a process whereby any label can be attached to a given molecule with the same probability. To demonstrate stochastic labeling methods experimentally the absolute and relative number of selected genes were determined after stochastically labeling 360,000 different fragments of the human genome. The approach does not require the physical separation of molecules and may take advantage of highly parallel methods such as microarray and sequencing technologies to simultaneously count absolute numbers of multiple targets. In some embodiments, stochastic labeling may be used for determining the absolute number of RNA or DNA molecules within single cells.

The methods disclosed herein may be used to take quantitative measurements of copies of identical molecules in a solution by transformation of the information to a digital process for detecting the presence of different labels. The stochastic properties of the method have been measured, and the relative and absolute digital counting of nucleic acid molecules is demonstrated. The method is extremely sensitive, quantitative, and can be multiplexed to high levels. In some aspects a microarray-based detection method is used, but the method is extendable to many other detection formats.

In some aspects, the methods are based on probability theory, where the outcome of chemical reactions occurring between a set of labeling molecules and a set of target molecules is modeled and tested. When all of the molecules in a uniform mixture of fixed volume collide and react randomly, the chemical events follow a stochastic process governed in part by the molecule concentration of each species (D. T. Gillespie, *The Journal of Physical Chemistry* 81, 2340 (1977)).

Methods for analyzing genomic information often utilize a correlation between a measurement of the amount of material associated with a location. The location can be, for example, a feature of an array that contains a specific sequence that is known or can be determined or any type of solid support such as a bead, particle, membrane, etc. A common aspect to these methods is often hybridization of a target to be measured to a complementary probe attached to the solid support. The probe may be, for example, an oligonucleotide of known or determinable sequence, but may also be BACs, PACs, or PCR amplicons.

Because of the density of different features that can be obtained using synthesis methods such as photolithography, microarrays can be applied to high density applications. For example, at feature sizes of 1 micron square an array can have about $10^8$ features per $cm^2$. Within a feature, depending on the chemistry used for synthesis, the probes are spaced typically at about 10 nm spacing resulting in about $10^4$ molecules in a $micron^2$. At approximately full saturation about 10% of those probes are hybridized with target. There are then about 640 functional molecules in an array having 1 $micron^2$ spacing between features (~800 $nm^2$ functional area). This relatively small number of functional molecules in a feature limits the dynamic range for estimating relative concentration from hybridization signal intensity.

Methods are disclosed herein to overcome the dynamic range limitations observed with small feature sizes and small numbers of molecules on the array surface, by using a counting or digital readout as a substitute for the typical analog signal resulting from array hybridization.

Methods that use signal intensity to estimate relative concentrations of targets typically label the targets with a detectable label, often after an amplification step, and through hybridization of the labeled target to the probe, the probe and thus the feature is also labeled. The amount of label is detected and correlated with a measurement of the amount of target in the sample. The estimate of amount of a given target in a sample is typically relative to other targets in the sample or to previously obtained measurements and may be based on comparison to targets present in the sample at known or expected levels or to controls within the sample. This type of analysis can and has been used successfully, for example, to estimate genomic copy number to detect copy number variation in individuals or in cell populations (see, for example, Pinkel & Albertson, *Annu. Rev. Genomics Hum. Genet.* 6, 331-354 (2005), Lucito et al. *Genome Res.* 13, 229102305 (2004), Sebat et al. *Science* 305, 525-528

(2004), Zhou et al., *Nat. Biotechnol.* 19, 78-81 (2001) and Zhao et al. *Cancer Res.* 65, 5561-5570 (2005) and US Patent Pub. Nos. 20040157243 and 20060035258) or to estimate gene expression levels (see, for example, Lockhart et al., *Nat. Biotechnol.* 14:1675-1680 (1996), and Wodicka et al., *Nat. Biotechnol.* 15:1359-1367 (1997)).

Correlating intensity of hybridization signal or signal intensity with concentration of target molecules has limitations and can typically provide only an estimate of the absolute amount of a target, and may not be an accurate count of the actual amount of target present. The estimate may be an under or over estimate, particularly when comparing different targets or different samples. This is the result of many different factors, including but not limited to, differences between probes, feature specific effects, sample specific effects, feature size (as it decreases the ability to correlate accurately decreases) and experimental variation. Much of this variation can be addressed by data analysis methods, but the methods do not provide counting of individual molecules or events and are therefore subject to estimation errors.

In preferred aspects methods are disclosed for attaching a different label-tag sequence to each molecule of a particular target sequence or more preferably a collection of target sequences of interest. For example, a sample having 100 molecules of target type 1 is mixed with an excess, for example, 1000 different label-tag sequences, forming a library of label-tag sequences under ligation conditions. Multiple copies of the library of label-tag sequences are added so there are preferably many copies of each label-tag. Different label-tag sequences from the library are appended to each of the 100 target molecules so that each of the 100 molecules of the first target sequence has a unique label-tag sequence appended thereto. This results in 100 different target-label-tag combinations. The target-label-tag molecules may then be amplified to enrich the target-label-tag products relative to other non-targets. Amplification after labeling alters the absolute amount of the target, but because each occurrence in the original sample has been uniquely labeled this will not alter the count. The amplified target-label-tag products, whether amplified or not, can then be labeled with a detectable label, and hybridized to an array of probes. The features of the array that have target-label-tag hybridized thereto can be detected, for example, by labeling the hybridization complex with a fluorescent label and detecting the presence of signal at the features. In this example, because there are 1000 different labels possible and a single target being analyzed, there are 1000 different possible label-target sequences that might be generated so an array having a different feature for each of the 1000 different possibilities can be used. Assuming each target is labeled and no label is used twice, 100 of the 1000 different features should be detectable, indicating the corresponding label has been used.

Consider 1 copy of a target molecule in solution identified as t1. React this target against a set of 10 labels, $L_m = \{l_1, l_2, \ldots l_{10}\}$. Each label has a 0.1 probability of being chosen. Next consider multiple copies of the target, $t_n$, reacted against the set of $L_m$ (assume non-depleting reservoir of labels). For simplicity, consider 3 copies of t: $t_1$, $t_2$ and $t_3$. Target $t_1$ will choose a label, $t_2$ has a 0.9 probability of choosing a different label, $t_3$ has a predictable probability of choosing the same label as $t_1$ or $t_2$. For n copies choosing from m labels, outcomes can be modeled by the binomial distribution as discussed above. For 3 targets and 10 labels, the probability of a label not being chosen, $P_0$ is $(1-(1/10))^3 = 0.729$. The probability $P_1$ of being chosen exactly once is $(3/10)(1-(1/10))^2 = 0.243$. The probability of being chosen twice, $P_2$ is 0.027 and the probability $P_3$ of being chosen 3 times is 0.001. Since $P_0$ is the probability of not being chosen, $1-P_0$ is the probability of being chosen at least once. We define $k = m(1-P_0)$ as the number of labels we expect to see in an experiment. Conversely, if we know m, and observe k we can solve for the number of molecules. In the previous example where n=3 and m=10 we expect to see $10(1-P_0)$ or 2.71 labels as our most probable outcome. Increasing m dramatically increases our counting efficiency, accuracy and dynamic range, e.g. for m=1,000, k(number of labels expected for n=10, k=9.96, for n=20, k=19.8.

Once the target molecules are labeled with the counter they can be amplified freely without impacting the counting since the readout is either yes, indicating detection or no indication not detected. In one aspect, a simple detector having m elements for each target sequence can be constructed. The detector may be an array. An array having $10^8$ features or elements could assay $10^5$ different targets using $10^3$ different labels, for example. Other detection methods do not require individual elements for each counter, for example, sequencing.

In preferred aspects the "counter library" or "label-tag library" has approximately the same number of copies of each label-tag in the library. The label-tag sequences are not target specific, but are like the tags that have been used for other tagging applications, for example, the Affymetrix GENFLEX tag array. Preferably all label-tags in a set of label-tags will have similar hybridization characteristics so that the label-tags of the set can be detected under similar conditions.

For each target there are a series of features on the array, preferably one feature for each label-tag. In each of these features the portion of the probe that hybridizes to the target (or target complement) is the same but the label-tag complement is different in each feature. For example, to detect a first target RNA, "RNA1", there would be a series of features each having a different probe (RNA1-tag1, RNA1-tag2 . . . RNA1tagN). For each target to be detected there is a similar set of features, e.g. RNA2-tag1, RNA2-tag2, . . . RNA2-tagN. The set of label-tags is N tags and it is the unique combination of the label-tag with the target sequence that creates a novel sequence to be detected, for example, by hybridization.

Label-tag attachment to individual targets is a stochastic process whereby the probability of any given label-tag being attached to any target is stochastic. There is a random selection of label-tags by attaching the label-tags to the end of a known target sequence in a sequence independent manner. The label-tag is attached without requirement for it to hybridize to any portion of the target so there is no or minimal bias as to which label-tag sequence is attached. Individual molecules all look the same for the purpose of attachment of the label-tag.

The label-tag may be attached to the target by any method available. In one embodiment, the label-tag is attached by ligation of the label-tag to one of the ends of the target. In preferred aspects the probes of the array are complementary to a predicted junction between target and label so it is preferable that the labels are attached to all occurrences of a target at the same position. This is facilitated if the termini of each occurrence of a selected target are the same and are known. In one aspect, target occurrences are fragmented with a restriction enzyme so that defined ends of known sequence are formed.

After label-tag attachment in some embodiments the target-label-tag segment is amplified. Attachment of universal primers to either end followed by PCR amplification is one method for amplifying. The universal primers may be added along with the label or at a subsequent ligation step.

For RNA targets an RNA ligase, such as T4 RNA ligase may be used. T4 RNA ligase 1 catalyses the ligation of a 5' phosphryl-terminated nucleic acid donor to a 3' hydroxyl-terminated nucleic acid acceptor. Substrates include single-stranded RNA and DNA. See, for example, Romaniuk, P. and Uhlenbeck, O. (1983) R. Wu, L. Grossman and K. Moldave (Eds.), Methods Enzymol., 100, pp. 52-56. New York: Academic Press and Moore, M. J. and Sharp, P. A. (1992) Science, 256, 992-997. RNA targets may also be circularized and used as template for rolling circle amplification using an enzyme having reverse transcriptase activity. T4 RNA ligase 1 may be used for circularization of RNA by ligating the ends of the molecule together. T4 RNA ligase 1 can also be used to ligated RNA to DNA.

Full-length mRNA can be selected by treating total or poly(A) RNA with calf intestinal phosphatase (CIP) to remove the 5' phosphate from all molecules which contain free 5' phosphates (e.g. ribosomal RNA, fragmented mRNA, tRNA and genomic DNA). Full-length mRNAs are not affected. The RNA can them be treated with tobacco acid pyrophosphatase (TAP) to remove the cap structure from the full-length mRNA leaving a 5'-monophosphate. A synthetic RNA adapter can be ligated to the RNA population. Only molecules containing a 5'-phosphate, (i.e. the uncapped, full-length mRNAs) will ligate to the adapters. Preferably the adapter has a variable label sequence, and may also have a constant sequence for priming. Preferably, the constant sequence is 5' of the variable sequence. In some aspects, the adapter ligated mRNA may then be copied to form a first strand cDNA by, for example, random priming or priming using oligo dT. The cDNA may subsequently be amplified by, for example, PCR.

T4 RNA ligase may also be used for ligation of a DNA oligo to single stranded DNA. See, for example, Troutt et al., (1992) Proc. Natl, Acad. Sci. USA, 89, 9823-9825.

In other aspects, the ligated target-label-tag molecule may be enriched in the sample relative to other nucleic acids or other molecules. This enrichment may be, for example, by preferentially amplifying the target-label-tag methods, using for example, a DNA or RNA polymerase, or by degrading non target-label-tag molecules preferentially.

In one aspect, the target-label-tag molecule may be nuclease resistant while the unligated target and unligated label molecules may be nuclease sensitive. A nuclease can be added to the sample after ligation so that ligated target-label-tag molecules are not digested but non-ligated molecules are digested. For example, the targets may be resistant to a 5' exonuclease (but not a 3' exonuclease) while the labels are resistant to a 3' exonuclease but not a 5' exonuclease. Ligating target to label generates a molecule that is resistant to 5' and 3' exonuclease activity. After ligation the sample may be treated with a 5' exonuclease activity, a 3' exonuclease activity or both 5' and 3' exonuclease activities. For examples of nucleases see Rittie and Perbal, J. Cell Commun. Signal. (2008) 2:25-45, which is incorporated by reference (in particular see Table 5). Exo VII, for example degrades single stranded DNA from both the 5' and 3' ends so the sample could be treated with Exo VII after ligation to degrade molecules that are not ligation products.

In another aspect amplification may include a rolling circle amplification (RCA) step. See for example, Baner et al. (1998) NAR 26:5073, Lizardi et al. (1998) Nat. Genet. 19:225, Fire and Xu, (1995) PNAS 92:4641-5, Zhao et al. Angew Chem Int Ed Engl. 2008; 47:6330-6337 and Nilsson et al. (2008), Trends in Biotechnology, 24:83-88. The targets may be ligated so that they have a label and a universal priming (UP) sequence attached to the 5' end of the targets. The UP-label-target is then ligated to form a circle. A primer complementary to the UP is then hybridized to the circles and extended using a strand displacing polymerase. The resulting amplification product contains multiple copies of the complement of the circle, UP-target-L.

In another aspect, targets may be labeled in a copying step. For example, a primer having a 3' target specific region and a 5' variable label region may be hybridized to the targets, either RNA or DNA, and extended to create a single complimentary copy of the target. Each extension product will have a different label and the junction between the label and the target specific region is known. The extension may be performed in the presence of nuclease resistant nucleotides so that the extension product is resistant to nuclease but the unextended primers are not. After extension the reaction is treated with a 3'-5' exonuclease activity to digest unextended primer. Exonuclease I, for example, removes nucleotides from single stranded DNA in the 3' to 5' direction and Exo III removes nucleotides from the 3' termini of duplex DNA. Exonuclease T (or RNase T) is a single-stranded RNA or DNA specific nuclease that requires a free 3' terminus and removes nucleotides in the 3' to 5' direction. The extension products are then detected by hybridization to probes that are complementary to the primers and include the unique label portion and the constant target specific portion. If the target is RNA it can be digested with RNase H after extension. The extension product may also be amplified before hybridization.

In some aspects the probability that any two targets are labeled with the same label may be decreased by using two or more labeling steps. For example, a first labeling step where each target has a label selected from a set of labels followed by a second labeling set using the same set of labels. The first labeling event will be independent of the second so the probability that the first and second labeling events will both be the same in two independent targets is the product of the probability of two targets having the same label in either step. If there are N possible labels, and the first target is labeled first with label N1 and then with label N4, the probability that a second target will be labeled also with N1 and then N4 is 1/N2. So if there are 100 different labels, the probability that two targets will be labeled with the same label in the first round and the same label in the second round is 1/10,000.

In another aspect a first round of labeling may be done with 16 probes (for example, all possible 2 base combinations) and then a second round of labeling is done using the same 16 probes. The chance of any one probe attaching to a given target occurrence in the first round is 1 out of 16, the chance that the same probe will attach to the second target is 1/16 and the chance that the same two probes will attach is 1/16×1/16 or 1/256.

In another aspect reversible terminators are used to add a sequence to the end of each target being counted. For example, a 6 base sequence may be added and the chance of two being the same is 1 in 46 or 1 in 4096. See, for example, WO 93/06121 and U.S. Pat. No. 6,140,493 which disclose stochastic methods for synthesizing random oligomers.

There is a finite set of labels, $L_{1-x}$ and each target to be detected is present in the sample at a certain integer occurrence $(T1_{1-t}^1, T2_{1-t}^2, \ldots TN_{1-t}^2)$. In a preferred aspect, the method is used to count the number of each of the different targets, (e.g. how many occurrences of T1, how many of T2, . . . how many of TN) in the sample. The targets are independently labeled with the label molecules. Labeling is stochastic, so that any given target occurrence can be labeled with any one of the labels. For example, T1-1/L689, T1-2/L3, T1-3/L4,567 and so on. For Target 2, any given occurrence can also be labeled with any of the label molecules. This might generate, for example, (T2-1, L5), (T2-2, L198), (T2-3, L34) and so on. There are multiple copies of each label so T2-1 might be labeled with L5 and T1-500 may also be labeled with L5.

The methods disclosed herein may be used to measure random cell-to-cell variations in gene expression within an isogenic population of cells. Such variation can lead to transitions between alternative states for individual cells. For example, cell-to-cell variation in the expression of comK in *B. subtilis* has been shown to select cells for transition to the competent state in which genes encoding for DNA uptake proteins are expressed. See, Maamar et al. *Science* 317:526-529 (2007) which is incorporated herein by reference.

Figure 6:
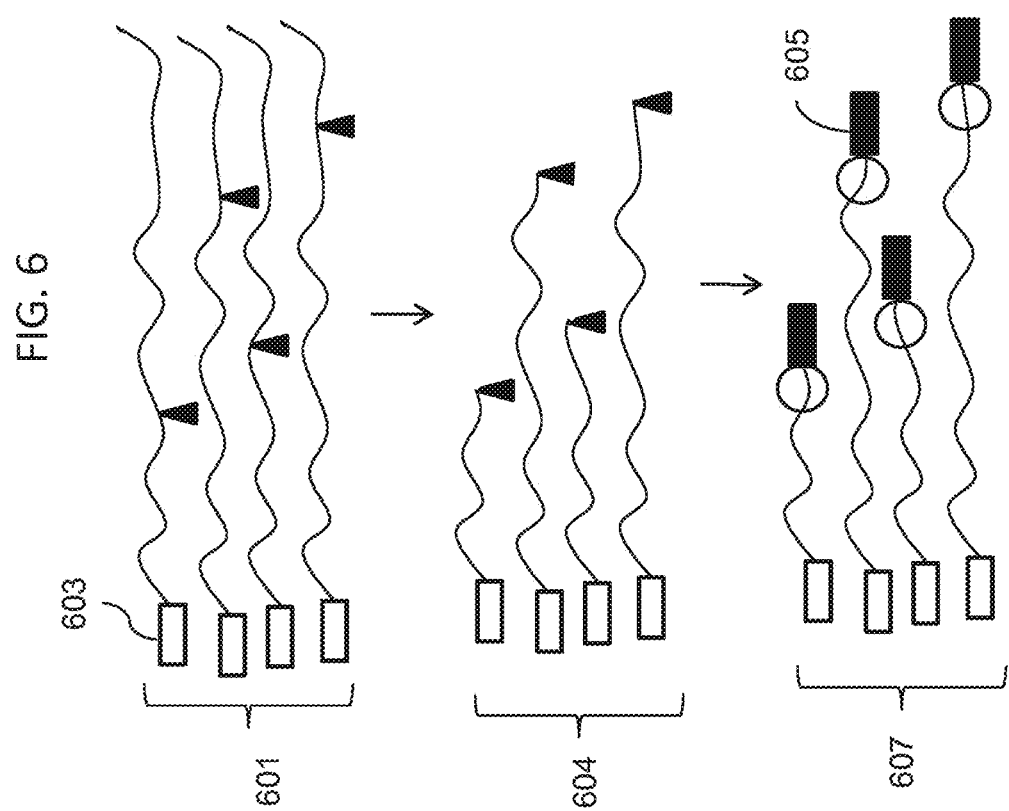
FIG. 6 shows a method for stochastic counting by fragmentation where the unique end of the fragment is the label used for counting.

In some aspects the labels are generated within the target to be counted. For example, the label may be a unique cleavage site in a target fragment as shown in FIG. 6. Each of the copies of the target to be counted 601 have a common sequence at one end identified in the figure as 603. This may be a common sequence that has been added to the targets through ligation or primer extension or it may be a naturally occurring sequence in the target. The targets are fragmented randomly, for example by shearing or sonnication resulting in cleavage at the points indicated by the arrows to generate cleavage products 604. Cleavage is at a different and unique site in each of the fragments and results in a unique sequence in the target immediately to the left of the point of cleavage in the illustration (indicated by circles in fragments 607). This unique sequence can function as a label for the disclosed methods. A second common sequence 605 may be attached to each of the targets immediately downstream of the cleavage point, through for example ligation of an adaptor sequence. The resulting targets 607 can be analyzed directly to determine how many unique sequences are present and using this number as an indication of the number of targets in the starting sample. This is illustrated for nucleic acids, but could similarly be applied to proteins or other contiguous strings of monomers or units that are assembled in a non repeating pattern.

Figure 7:
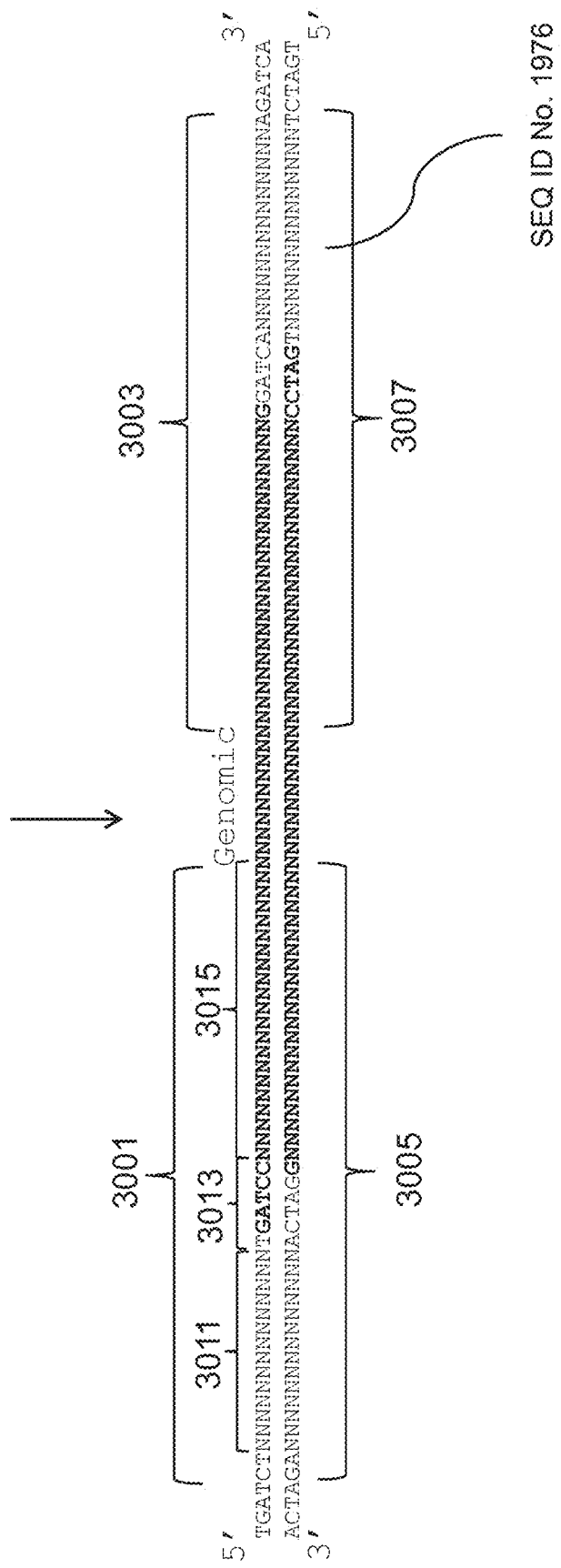
FIG. 7 provides an example of a genomic target ligated at either end to a label adaptor.

FIG. 7 shows a strategy for selecting probes for target fragments. For a double stranded fragment there are 4 possible junctions that can be targeted with array probes 3001, 3003, 3005 and 3007. Each of these junction regions as shown has a counter region 3011 denoted by N's, a fixed sequence 3013 that is defined by the restriction enzyme used for fragmentation and a target specific region 3015. The region 3015 is shown as N's but in preferred aspects it is a known and predictable sequence of the target that is adjacent to the selected restriction site. In a preferred aspect, the array probes are complementary to at least a portion of 3011, a portion of 3015 and all of 3013. For each target sequence-counter combination there are 4 different probes that could be included on the array. For example, if the targets are 10 loci from each of 4 chromosomes and 4 probes per fragment are included for 1200 different labels (1000 specific plus 200 non-specific) the array would have 192,000 total probes (4×10×4×1200).

In some aspects methods for selecting a collection of labels optimized for use in the disclosed methods is contemplated. For example, a list of all possible 14 mers may be used as a starting pool ($4^{14}$ is ~268 million different sequences). Different label lengths can be used resulting in different numbers of starting sequences. Eliminate all labels that are not at least 50% GC content. Eliminate all labels that do not use each of the 4 possible nucleotides at least twice. Eliminate all labels that have more than two Gs or Cs in tandem, e.g. a probe with GGG or CCC would be eliminated, or with more than three As or Ts in tandem, e.g. AAAA or TTTT would be removed. Remove labels that contain a selected restriction site. Remove labels having a Tm that is outside of the range (38.5 to 39.5° C.). In other embodiments the range may be about 38 to 40, 38-39, or 39-40. Remove probes that have self complementarity beyond a selected threshold. Perform a hierarchical clustering to maximize sequence differences between labels to minimize cross hybridization, same label to same probe. Minimize self-complementarity within the collection to reduce tendency of two labels binding to each other.

Figure 8:
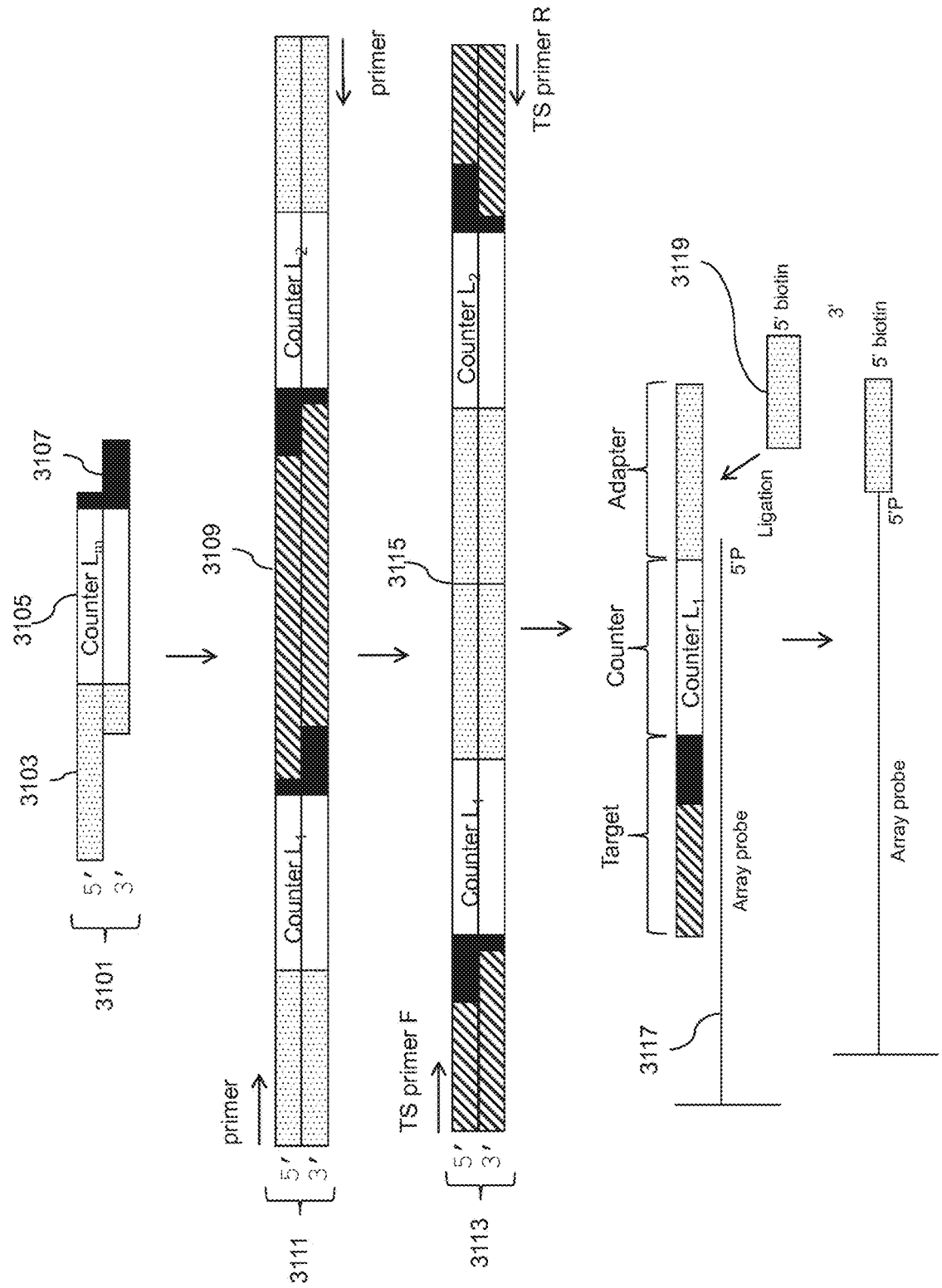
FIG. 8 shows a schematic of the arrangement and position of the adaptors, PCR primers, and the biotinylated array-ligation probe in one exemplary sample prep method.

FIG. 8 shows a counter adaptor 3101 that includes a counter region 3103, a constant region for priming 3105 and a sticky end 3107 for ligation to an overhang created by restriction digestion, for example with BamHI. After ligation of the adaptors 3101 to the target fragment 3109 there are two adaptors ligated to the target fragment, one at either end. It is probable that the counters on the two ends will be different although there is a predictable probability of having the same counter ligated to both ends of the same fragment. After adaptor ligation the fragment 3111 can be amplified by PCR using a common primer to the 3103 region of the adaptor. The adaptor may first be filled in to make it double stranded. The PCR amplification may be used to preferentially amplify fragments of a selected size range, for example, 300 to 2 kb. Smaller fragments are not amplified as efficiently because of self complementarity between the ends of the individual strands (capable of forming a panhandle structure that inhibits amplification) and longer fragments (longer than about 3 kb) also don't amplify well.

After circularization, the uncircularized fragments can be digested using an exonuclease, for example. The circularized fragments can be amplified using target specific primers to generate amplification product 3113. In the figure the target specific primers are identified as TS primer F and TS primer R. Whereas the primers used to amplify 3111 are common to all adaptor ligated fragments and will amplify all fragments that are in the size range to be amplified using PCR, the TS primers are specific for selected targets to be analyzed. The amplification product 3113 has in the 5' to 3' direction, target specific sequence, overhang sequence, a first counter, first adaptor sequence, circularization junction 3115, second adaptor sequence, second counter, second overhang sequence and a second target specific sequence. The first and second counter are different (although they may be the same at a low probability) and the first and second target sequence are different. The product 3113 or preferably fragments thereof can be detected by a variety of methods, for example, an array of probes as exemplified by probe 3117 can be used. The array probe 3117 is complementary to a region of the target, the overhang region and the counter. When hybridized the target will have an overhanging single stranded region that corresponds to the adaptor sequence. A labeled probe 3119 that is complementary to one strand of the adaptor can be hybridized and the ligated to the array probe as shown, and as described below.

Figure 9:
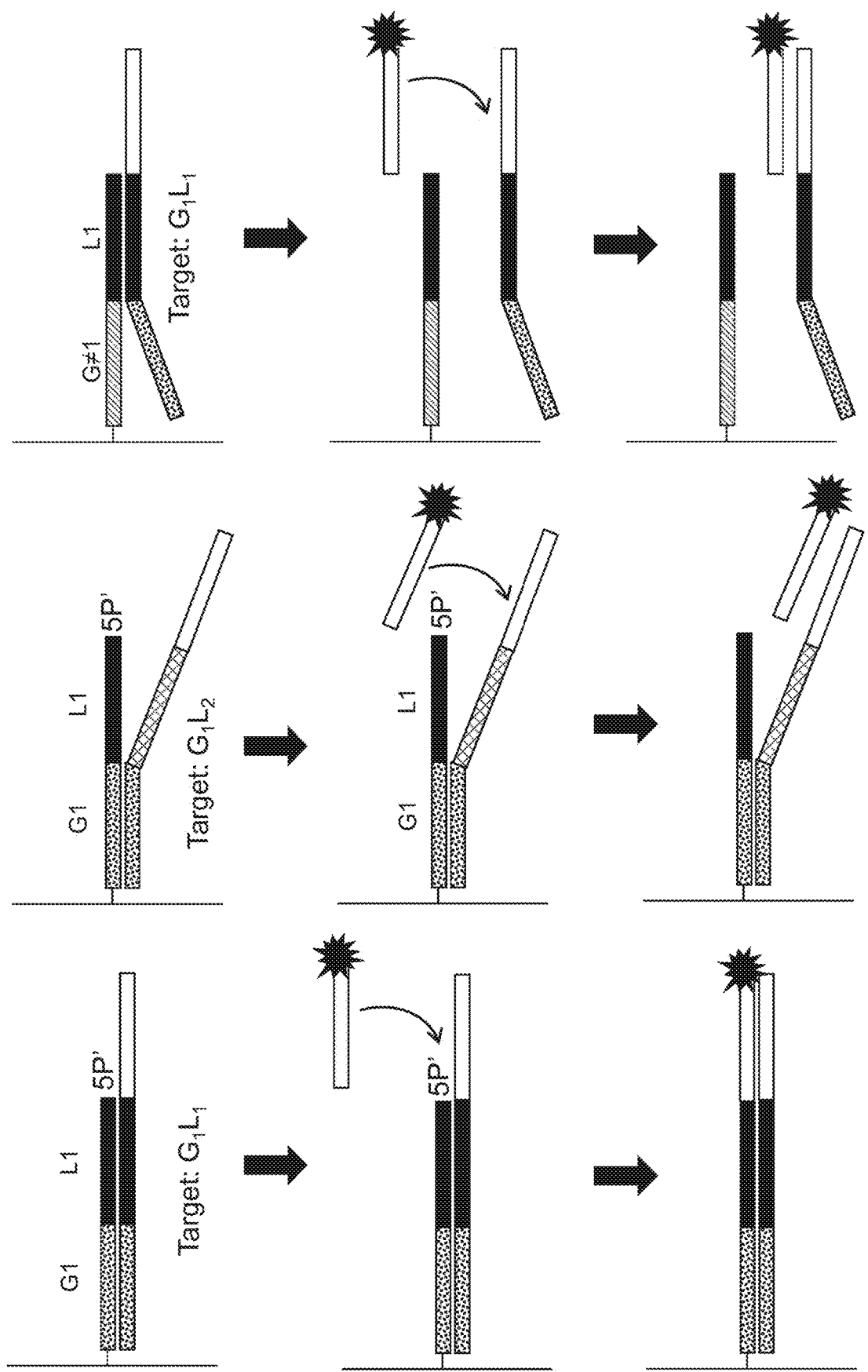
FIG. 9 is a schematic of a method for using ligation based read out on arrays to detect labeled targets and minimize partial target hybridization.

FIG. 9 shows a method for reading out the labeled targets on arrays. On the left, the target with $G_1$ ligated to $L_1$, "$G_1L_1$", is shown hybridizing to the complementary array probe over the entire length of the probe. On the right target $G_1$ ligated to label $L_2$ is shown partially hybridized to the $G_1L_1$ probe on the array. On the left the biotin labeled constant segment can hybridize to the $G_1L_1$ target and ligate to the 5' end of the $G_1L_1$ array probe. The constant segment can hybridize to the $L_2$ segment but will not ligate to $L_1$. This allows for labeling of properly hybridized target-label pairs with both hybridization and ligation discrimination. The lower panel shows an example where the target or G portion is not matching with the probe on the array. This will not ligate efficiently because it hybridizes less stably.

The left panel shows the results when target $G_1$ ligated to label $L_1$ to form $G_1L_1$ hybridizes to the complementary $G_1L_1$ probe on the array. The constant region (in white) can hybridize to its labeled complement so that the 3' end of the labeled complement is juxtaposed with the 5' end of the $L_1$ region of the probe on the array and the ends can be ligated. In the center panel the target hybridizing to the $G_1L_1$ probe is non-cognate, the label region is $L_2$ and not $L_1$ so it does not hybridize to the $L_1$ region of the probe. The labeled oligo can hybridize to the partially hybridized target but it is not juxtaposed with the 5' end of the $L_1$ region of the probe so it should not ligate to the probe. In the right panel the target shown hybridized has the $L_1$ region and is complementary to the array probe at that region, but the array probe has a G region that is not $G_1$ so the $G_1L_1$ target does not hybridize. The labeled oligo can hybridize to the target but because the L1:L1 region is short the duplex is not stable and the labeled oligo does not ligate to the end of the array probe.

If you have N targets T ($T_1, T_2, \ldots T_N$) and each is present at a number of copies C ($C_1, C_2, \ldots C_x$) where X varies from target to target ($X_{T1}, X_{T2}, \ldots X_{TN}$) and you ligate to a set of Y different labels ($L_1, L_2, \ldots L_Y$) then you generate, for example, $T_1C_1L_1, T_1C_2L_2, \ldots T_NC_XL_{XT1}$, where X<<<Y). So, for example, if T1 is gene A and T2 is gene B and gene A is present in the sample at 500 copies and gene B is present at 100 copies, each copy of gene A, 1 to 500, will be attached to a different label (so there will be—500 different labels attached to the gene A copies), and each copy of gene B, 1 to 100, will be attached to a different label.

A method for counting the number of occurrences of each of a plurality of same targets in a mixture of targets comprising multiple occurrences of each type of a plurality of different targets. In preferred aspects, the mixture of targets is a nucleic acid sample that contains different amounts of multiple target sequences. For example, there may be target sequences 1, 2, 3, 4 and 5 that are expression products from 5 different genes, occur in the sample as follows: 1000 copies of target 1, 100 copies of target 2, 500 copies of target 3, 10 copies of target 4 and 50 copies of target 5. The targets are preferably of known sequence and are treated so that they may be ligated to a label-tag sequence.

FIG. 1 shows one embodiment of the method. Labels or counters 101 are combined with assay targets 103 so that each target is combined with one label to form label-targets 105. The process of combining an individual target with individual label molecules is a stochastic process. The number of labels each target type combines with is directly proportional to the number of individual targets of that target type or the copy number of the target. The number of labels is counted by hybridization to arrays where individual label-targets are detected at different features.

The targets are mixed with a collection of label-tag sequences, each label-tag being a different sequence and the collection having a number that is preferably 10 times the number of copies of the most abundant target to be counted. In a preferred aspect, the label-tags are a collection of known sequences such as a collection of all possible 6mers ($N_6$). Each of the label-tag sequences is present in multiple copies in the mixture, but all are present at approximately equal amounts. The label-tag sequences are ligated to the targets. Ligation is random so that any given label-tag has about the same probability of ligating to any one target occurrence. So if there are 1000 different targets each could be ligated to a different label-tag sequence and the probability that any two target occurrences will have the same label-tag ligated is low. Because the ligation is a random stochastic process there is a known probability that if there are C copies of a given target and N different label-tags that any two copies of a target T will have the same label.

T1, T2, ... TN. C1, C2, ... CX, L1, L2, ... LY where T are the different targets and there are N different targets, C are the different copies of a target and there are X copies of that target and L are the different label label-tags and there are Y label tags. X varies for each target and determining X is one of the objects of the present invention. The relationship between X and Y determines the probability that two C's will have the same L. In preferred aspects Y is greater than X for each target to be counted. This reduces the probability of undercounting due to double labeling. If C1 and C2 of T1 are both labeled with L3 both copies will be counted as a single occurrence, resulting in under counting. Undercounting can also be adjusted for by estimating the number of copies that are likely to be multiply labeled and adjusting the final count upwards to take those into account. For example, if there is a likelihood that 5 of 1000 copies will be labeled with the same label tag then the final number should be adjusted up by 0.5%.

In preferred aspects, the detection is by hybridization to an array of probes. The array has a collection of features for each target that includes a different feature for each label tag. For example, if there are X label tags there are X features for each target, T1L1, T1L2, ... T1LX and the same for target 2, T2L1, T2L2, ... T2LX, out to TNL1, TNL2, ... TNLX. The number of features of the array is on the order of X times N. Each probe has a target complementary sequence and a label tag complementary sequence. Within a set of probes for a given target the target segment of the probe would remain constant and the label tag portion varies from feature to feature so that each label tag sequence is represented by at least one feature for each target.

In one aspect, the methods may be used to count the number of copies of each of a plurality of targets in a sample. The amount of target containing sample mixed with the label tags may be diluted so that the number of copies of each target to be counted is less than the number of label tags. For example, if the targets to be counted are present at about 1,000 copies per cell and there are 10,000 label tags you want to have the amount of sample in the mixture to be about the equivalent of one cell's worth of RNA. You can mix that with multiple copies of each label-tag, but you want to keep the absolute number of copies of target below the number of types of label tag sequences. Dilution of the sample and use of an appropriately small amount of starting material may be used. If a target sequence is present at low copy number per cell it is possible to use the nucleic acid from a larger number of cells. For example, to measure the DNA copy number of a chromosomal region relative to other chromosomal regions the expected copy number is low (e.g. 2 for normal) so if there are 10,000 different label tags, the number of genomes that can be added to the sample for attachment of label tags can be high, e.g. 500 to 1000.

In one aspect, the methods are used to identify regions of genomic amplification and chromosomal abnormalities. For example, the methods may be used to detect trisomy. Most of the chromosomal regions will be present in 2 copies per cell and the region of trisomy will be present in 3 copies per cell. You would expect to observe a 3:2 ratio in your count. For example, if you have 500 genomes you would have 1000 copies of most regions and 1500 copies of the trisomy regions. Small errors in the counting, resulting from under-counting, would have little or no effect on the counting.

In some aspects, controls of known copy number may be spiked in to a sample to determine accuracy.

Stochastic labeling of $t1,_N$ (collection of essential identical molecules of copy 1, 2 . . . N of target 1) by $L_{1,m}$ (effectively an infinite reservoir of diversity m when m is much greater than N). This allows for complete or near complete resolution of members of t1,N, by imparting separate identities to the members of the collection of $t_{1,N}$ (provided that M is sufficiently smaller than N in the labeling). This provides for a stochastic or random projection of $t_{1,N}$ onto $L_{1,m}$. In some aspects $L_{1,m}$ is a library and the members of the library that are associated with $t_{1,N}$ can be counted to determine the number of copies of the target. In some aspects the methods can be described as indexing the members of the target. This provides a method to follow individual molecules that are members of a type of molecule that would not otherwise be distinguishable one from another.

Because stochastic labeling can impart identifiability to otherwise non-identifiable molecules it can impart identifiability to any two targets that may be very similar, but different. Examples of targets that may be highly similar but could be separately counted using the disclosed methods, include, for example, alternative splice forms of a gene, and sequences that have one or more variations, including a variation in a single base (e.g. SNP or indels (insertion or deletions of short regions, e.g. 1-5 bases). In some aspects the methods impart a clonal labeling, that allows a single copy to be separately detected and separately isolated from the solution.

Some nucleic acid sequencing reactions use methods that stochastically attach targets to a solid support followed by amplification of the attached target and analysis. The target attaches in an unknown location and the location can be determined by sequencing the amplified target at specific locations. In contrast, the disclosed methods provide for clonal amplification of known targets in a known location. The stochastic nature of the formation of the target-label-tag molecule provides a mechanism for isolating single occurrences of selected targets that can be subsequently amplified and analyzed. In some aspects the label can be used as a handle for isolating clonal populations of targets. The labeling step generates an indexed library that has a variety of applications. For example, the indexed library could be used for sequencing applications. The method adds distinguishability to any set of molecules, even molecules that are not distinguishable by other mechanisms because they may share common regions or even been identical. The indexed library can be stored and used multiple times to generate samples for analysis. Some applications include, for example, genotyping polymorphisms, studying RNA processing, and selecting clonal representatives to do sequencing.

In some aspects the methods are used to stochastically label a polyclonal antibody population. This may be used to identify different polyclonal populations.

The methods may be used to convert an analog readout of hybridization signal intensities on arrays into a measurable process that can be scored digitally on the arrays. The method leverages a random process where the tagging of assayed molecules is governed by stochastic behavior. In a random process, the more copies of a given target, the greater the probability of being tagged with multiple labels. A count of the number of incorporated labels for each target can approximate the abundance level of a given target of interest. The ability to count labels on microarrays would be a clear cost-advantage over the other existing techniques.

Serial analysis of gene expression (SAGE) is another method for analysis of gene expression patterns. SAGE relies on short sequence tags (10-14 bp) within transcripts as an indicator of the presence of a given transcript. The tags are separated from the rest of the RNA and collected. The tags can be linked together to form long serial molecules that can be cloned and sequenced. Quantitation of the number of times a particular tag is observed provides an estimate of the relative expression level of the corresponding transcript, relative to other tagged transcripts. See, for example, Velculescu et al. Science 270, 484-487 (1995) and Velculescu et al. Cell 88 (1997). Again this method provides a relative estimate of the abundance of a transcript and not an actual count of the number of times that transcript appears. Other methods based on counting and estimating relative abundance have also been described. See, for example, Wang et al. *Nat. Rev. Genet.* 10, 57-63 (2009). Additional methods for digital profiling are disclosed, for example, in U.S. Patent Pub. 20050250147 and U.S. Pat. No. 7,537,897.

A stochastic counting assay system as described herein can also be a sub-system within a much larger bio-analysis system. The bio-analysis system could include all the aspects of sample preparation prior to, for example, optical detection, the post processing of data collected in the optical detection phase and finally decision making based on these results. Sample preparation may include steps such as: extraction of the sample from the tested subject (human, animal, plant environment etc.); separation of different parts of the sample to achieve higher concentration and purity of the molecules under investigation; sample amplification (e.g. through PCR); attachment of fluorescence tags or markers to different parts of the sample; and transfer of the sample or a portion of the sample into a reaction vessel or site on a substrate. The post processing of the collected data may include: normalization; background and noise reduction; and statistical analysis such as averaging over repeated tests or correlation between different tests. The decision making may include: testing against a predefined set of rules and comparison to information stored in external data-bases.

The applications and uses of the stochastic labeling and counting methods and systems described herein can produce one or more result useful to diagnose a disease state of an individual, for example, a patient. In one embodiment, a method of diagnosing a disease comprises reviewing or analyzing data relating to the presence and/or the concentration level of a target in a sample. A conclusion based review or analysis of the data can be provided to a patient, a health care provider or a health care manager. In one embodiment the conclusion is based on the review or analysis of data regarding a disease diagnosis. It is envisioned that in another embodiment that providing a conclusion to a patient, a health care provider or a health care manager includes transmission of the data over a network.

Accordingly, business methods relating to the stochastic labeling and counting methods and methods related to use thereof as described herein are provided. One aspect of the invention is a business method comprising screening patient test samples for the amount of a biologically active analyte present in the sample to produce data regarding the analyte, collecting the analyte data, providing the analyte data to a patient, a health care provider or a health care manager for making a conclusion based on review or analysis of the data regarding a disease diagnosis or prognosis or to determine a treatment regimen. In one embodiment the conclusion is provided to a patient, a health care provider or a health care manager includes transmission of the data over a network.

Applications for the disclosed methods include diagnosing a cancerous condition or diagnosing viral, bacterial, and other pathological or nonpathological infections, as described in U.S. Pat. No. 5,800,992. Additional applications of the disclosed methods and systems include, pathogens detection and classification; chemical/biological warfare real-time detection; chemical concentration control; dangerous substance (e.g., gas, liquid) detection and alarm; sugar and insulin levels detection in diabetic patients; pregnancy testing; detection of viral and bacterial infectious diseases (e.g. AIDS, Bird Flu, SARS, West Nile virus); environmental pollution monitoring (e.g., water, air); and quality control in food processing.

Any available mechanism for detection of the labels may be used. While many of the embodiments discussed above use an array readout form, it will be obvious to one of skill in the art that other methods for readout may be used. For example, sequencing may be preferred in some embodiments.

In some aspects the readout is on an array. The array may be a solid support having immobilized nucleic acid probes attached to the surface in an ordered arrangement. The probes may be, for example, synthesized in situ on the support in known locations using photolithography or the probes may be spotted onto the support in an array format. As discussed above, in some embodiments the array includes a probe feature for each possible label-target combination. A feature preferably includes many copies of a single probe sequence. The feature may also have some probes that are not full length, resulting from truncation of synthesis. The photo activation process may not be 100% efficient so some probes are terminated at each step without having subsequent bases added. These truncated probes have the sequence of a portion of the full length probe.

Sequencing readout. After attachment of the labels to the targets in a stochastic manner, the targets may be amplified according to any of the methods disclosed herein and the amplification product may be subjected to any available sequencing method.

A number of alternative sequencing techniques have been developed and many are available commercially. For a review see, for example, Ansorge New Biotechnology 25(4): 195-203 (2009), which is incorporated herein by reference. These include the use of microarrays of genetic material that can be manipulated so as to permit parallel detection of the ordering of nucleotides in a multitude of fragments of genetic material. The arrays typically include many sites formed or disposed on a substrate. Additional materials, typically single nucleotides or strands of nucleotides (oligonucleotides) are introduced and permitted or encouraged to bind to the template of genetic material to be sequenced, thereby selectively marking the template in a sequence dependent manner. Sequence information may then be gathered by imaging the sites. In certain current techniques, for example, each nucleotide type is tagged with a fluorescent tag or dye that permits analysis of the nucleotide attached at a particular site to be determined by analysis of image data.

In another aspect, mass spec analysis may be used to detect the labels and count the targets. The labels can be distinguishable based on size or other property that can be detected. Many of the examples provided herein identify the label based on unique nucleic acid sequence but any distinguishable label may be used, for example, the pool of labels may be labels that are differentially detectable based on fluorescence emission at a unique wavelength.

FIG. 9 shows a method for reading out the labeled targets on arrays. On the left, the target with $G_1$ ligated to $L_1$, "$G_1L_1$", is shown hybridizing to the complementary array probe over the entire length of the probe. On the right target $G_1$ ligated to label $L_2$ is shown partially hybridized to the $G_1L_1$ probe on the array. On the left the biotin labeled constant segment can hybridize to the $G_1L_1$ target and ligate to the 5' end of the $G_1L_1$ array probe. The constant segment can hybridize to the $L_2$ segment but will not ligate to $L_1$. This allows for labeling of properly hybridized target-label pairs with both hybridization and ligation discrimination. The lower panel shows an example where the target or G portion is not matching with the probe on the array. This will not ligate efficiently because it hybridizes less stably.

The left panel shows the results when target $G_1$ ligated to label $L_1$ to form $G_1L_1$ hybridizes to the complementary $G_1L_1$ probe on the array. The constant region (in white) can hybridize to its labeled complement so that the 3' end of the labeled complement is juxtaposed with the 5' end of the $L_1$ region of the probe on the array and the ends can be ligated. In the center panel the target hybridizing to the $G_1L_i$ probe is non-cognate, the label region is $L_2$ and not $L_1$ so it does not hybridize to the $L_1$ region of the probe. The labeled oligo can hybridize to the partially hybridized target but it is not juxtaposed with the 5' end of the $L_1$ region of the probe so it should not ligate to the probe. In the right panel the target shown hybridized has the $L_1$ region and is complementary to the array probe at that region, but the array probe has a G region that is not $G_1$ so the $G_1L_1$ target does not hybridize. The labeled oligo can hybridize to the target but because the L1:L1 region is short the duplex is not stable and the labeled oligo does not ligate to the end of the array probe.

The methods are broadly applicable to counting a population of molecules by performing a stochastic operation on the population to generate a stochastic population of identifiable molecules. The targets need not be identical. For example, the methods may be used to count the absolute number of members of a group. In one aspect, a sample having an unknown number of copies of a selected nucleic acid target is fragmented randomly so that on average each copy of the target has a different end resulting from a distinct fragmentation event. A common adaptor sequence can be ligated to the end of each fragment and used for amplification of the fragments. Each ligation event generates a new molecule having a junction formed by the end of the random fragment and the adaptor sequence. The new junction can be detected by, for example, sequencing using a primer complementary to the adaptor or a region of the adaptor. Because the fragmentation was a stochastic process the number of different ends detected is a count of the number of different starting target molecules, assuming one fragment per starting target molecule.

The examples provided herein demonstrate the concept of using a stochastic labeling strategy in the high sensitivity detection and counting of individual DNA molecules. The difficult task of quantifying single nucleic acid molecules is converted into a simple qualitative assay that leverages the statistics of random probability; and at the same time, the requirement of single molecule detection sensitivity is achieved with PCR for the robust amplification of single DNA molecules. In some aspects improved methods for amplification will be used. For example, linear amplification methods may be used to mitigate the representation distortions created by exponential cycling in PCR. Given the lack of available techniques for single molecule counting, and the increasing need for its use, the new concept of stochastic labeling is likely to find numerous applications in the near future.

EXAMPLES

To demonstrate stochastic labeling, we performed an experiment to count small numbers of nucleic acid molecules in solution. Genomic DNA from a male individual with Trisomy 21 was used to determine the absolute and relative number of DNA copies of chromosomes X, 4 and 21, representing 1, 2 and 3 target copies of each chromosome, respectively. Genomic DNA isolated from cultured B-Lymphocytes of a male caucasion with Trisomy 21 was purchased from The Coriell Institute for Medical Research (Catalog #GM01921). The DNA quantity was determined by PICOGREEN dye (Invitrogen) measurements using the lambda phage DNA provided in the kit as reference standard. DNA quality was assessed by agarose gel electrophoresis.

The DNA concentration in the stock solution was measured by quantitative staining with picogreen fluorescent dye, and dilutions containing 3.62 ng, 1.45 ng, 0.36 ng and 0.036 ng were prepared. In each dilution, the number of copies of target molecules in the sample was calculated from a total DNA mass of 3.5 pg per haploid nucleus (see, T. R. Gregory et al., *Nucleic Acids Res* 35, D332 (2007), and represent approximately 500, 200, 50 and 5 haploid genomes. The absolute quantity of DNA in the sample was determined by optical density measurements and quantitative staining with PICOGREEN fluorescent dye (Invitrogen) prior to making dilutions.

Figure 3:
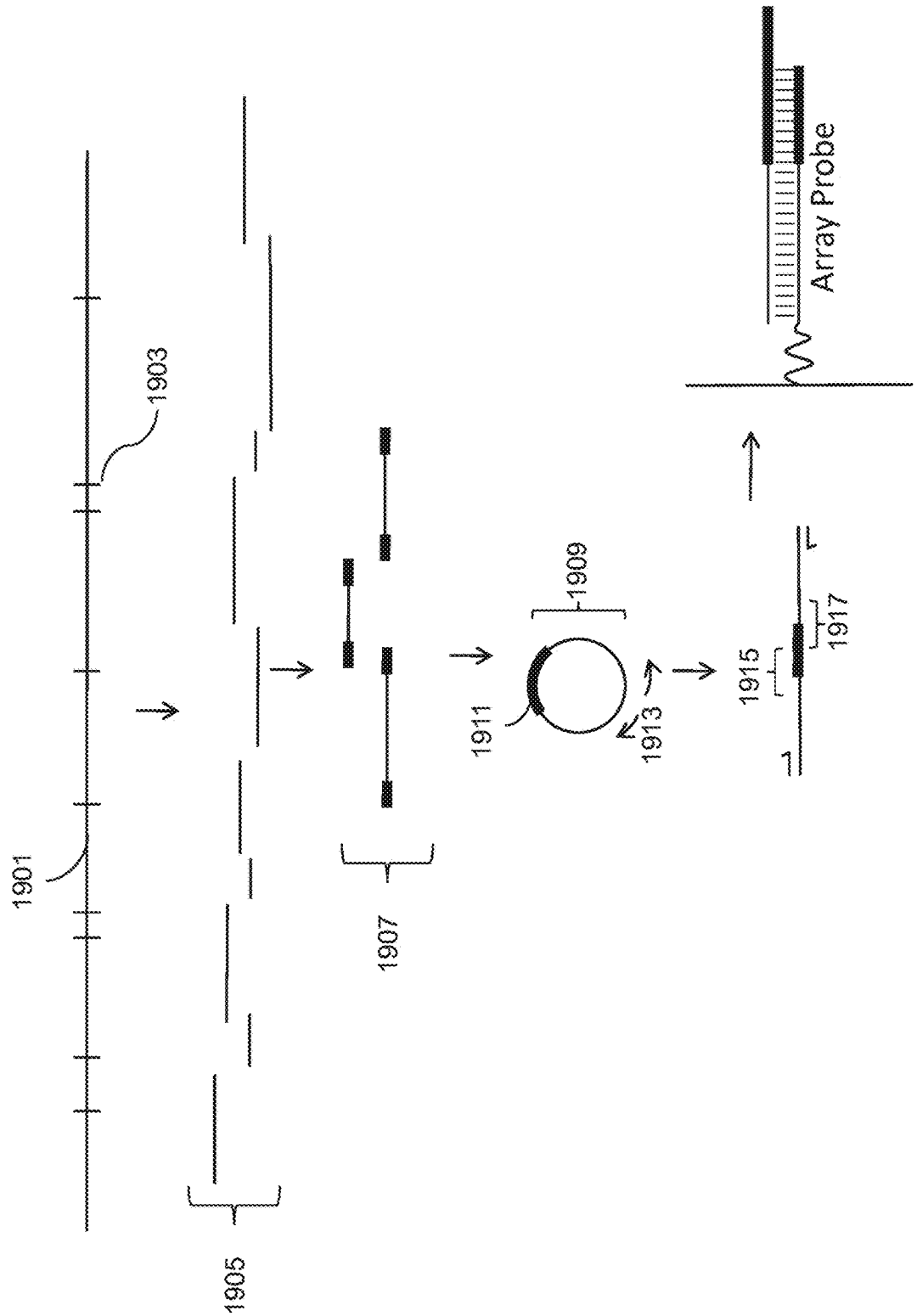
FIG. 3 shows a schematic of a method for circularizing targets and amplifying with gene specific primers.

As outlined in FIG. 3, the genomic DNA sample 1901 was first digested to completion with the BamHI restriction endonuclease to produce 360,679 DNA fragments 1905. A diverse set of labels consisting of 960 14-nucleotide sequences was synthesized as adaptors harboring BamHI overhangs (SEQ ID Nos. 44-1963). Genomic DNA was digested to completion with BamHI (New England BioLabs, NEB) and ligated to a pool of adaptors consisting of an equal concentration of 960 distinct labels. Each adaptor consists of a universal PCR priming site, a 14 nucleotide long counter sequence and a BamHI overhang (similar to the form of the adaptor shown in FIG. 7). The sequence of the label adaptors SEQ ID Nos. 44-1963 were selected from an all-possible 4$^{14}$ nucleotide combination to be of similar melting temperature, minimal self-complementation, and maximal differences between one-another. Homopolymer runs and the sequence of the BamHI restriction site were avoided. Each pair, for example, SEQ ID Nos. 44 and 45, form an adaptor pair that has a region of complementarity starting at base 12 in SEQ ID No. 44 and base 5 in SEQ ID No. 45:

```
                                                    SEQ ID 44
5'CGACAGACGCCTGATCTTTTGTTAGCCGGAGT 3'

SEQ ID 45
3'ACTAGAAAACAATCGGCCTCACTAG5'
```

The adaptors have a 5' overhang of 11 bases in the even numbered SEQ IDs and 4 bases (GATC) in the odd numbered SEQ IDs. Oligonucleotides were synthesized (Integrated DNA Technologies) and annealed to form double-stranded adaptors prior to pooling. For ligation, the digested DNA was diluted to the desired quantity and added to 100 pmoles (equivalent to 6×10$^{13}$ molecules) of pooled label-adaptors, and 2×10$^{6}$ units (equivalent to 1×10$^{13}$ molecules) of T4 DNA ligase (NEB) in a 30 µl reaction. The reaction was incubated at 20° C. for 3 hours until inactivation at 65° C. for 20 minutes.

Figure 21:
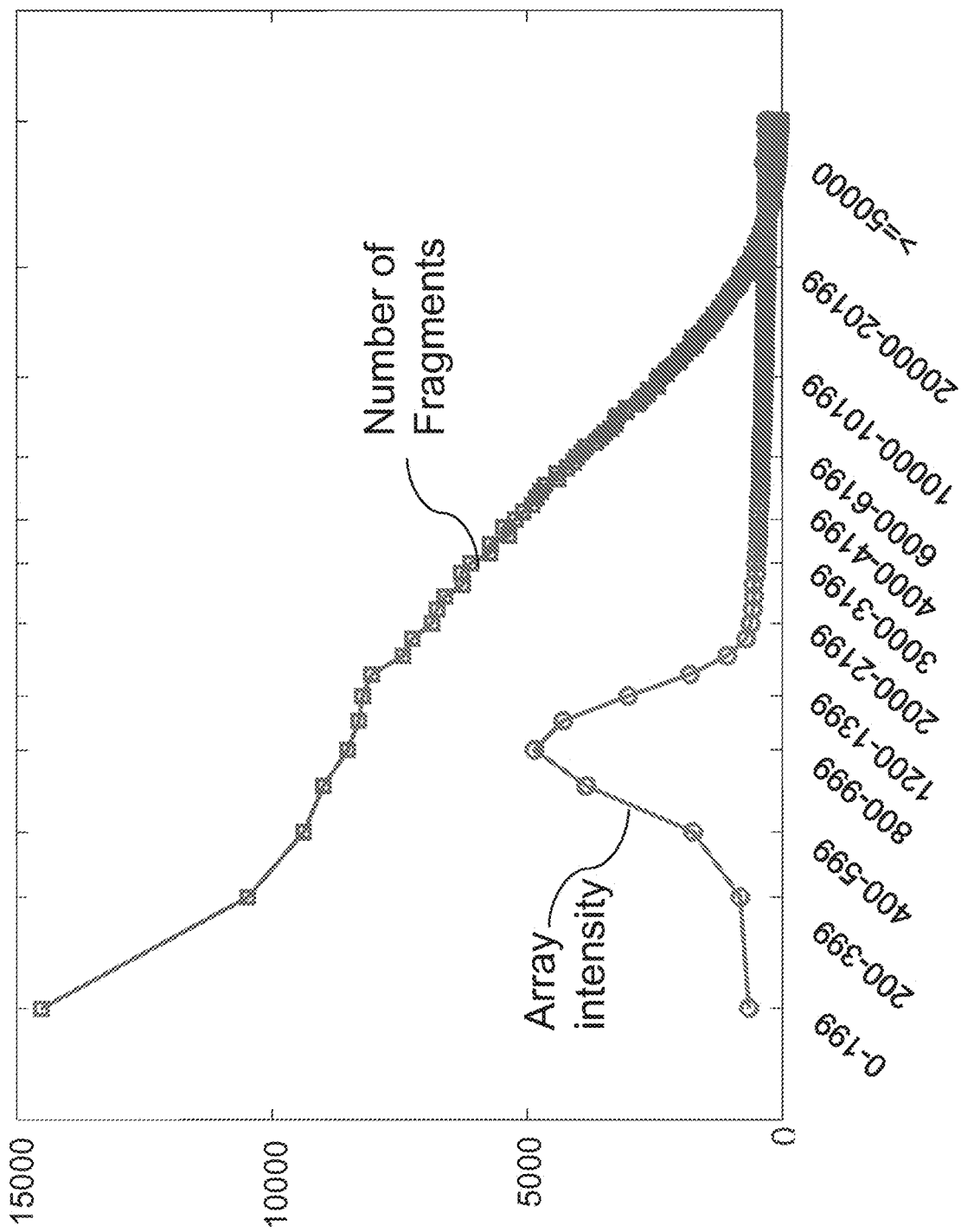
FIG. 21 is a plot of labels the array intensity observed compared to the number of fragments when fragments are binned according to size.

For the stochastic labeling reaction, each DNA fragment-end randomly attaches to a single label by means of enzymatic ligation of compatible cohesive DNA ends to generate labeled fragments 1907. High coupling efficiency is achieved through incubation with a large molar excess of labels and DNA ligase enzyme (~10$^{13}$ molecules each). At this stage, the labeling process is complete, and the samples can be amplified as desired for detection. A universal primer may be added added, and the entire population of labeled DNA fragments may be PCR amplified. The PCR reaction preferentially amplifies approximately 80,000 fragments in the 150 bp-2 kb size range (FIG. 21). Adaptor-ligated fragments were amplified in a 50 µl reaction containing 1× TITANIUM Taq PCR buffer (Clontech), 1M betaine (Sigma-Aldrich), 0.3 mM dNTPs, 4 µM PCR004StuA primer (SEQ ID No. 1974), 2.5U Taq DNA Polymerase (USB), and 1× TITANIUM Taq DNA polymerase (Clontech). An initial PCR extension was performed with 5 minutes at 72° C.; 3 minutes at 94° C.; followed by 5 cycles of 94° C. for 30 seconds, 45° C. for 45 seconds and 68° C. for 15 seconds. This was followed by 25 cycles of 94° C. for 30 seconds, 60° C. for 45 seconds and 68° C. for 15 seconds and a final extension step of 7 minutes at 68° C. PCR products were assessed with agarose gel electrophoresis and purified using the QIAQUICK PCR purification kit (Qiagen).

The purified PCR product was denatured at 95° C. for 3 minutes prior to phosphorylation with T4 polynucleotide kinase (NEB). The phosphorylated DNA was ethanol precipitated and circularized using the CIRCLIGASE II ssDNA Ligase Kit (Epicentre). Circularization was performed at 60° C. for 2 hours followed by 80° C. inactivation for 10 minutes in a 40 µl reaction consisting of 1× CIRCLIGASE II reaction buffer, 2.5 mM MnCl2, 1M betaine, and 200U CIRCLIGASE II ssDNA ligase. Uncirculated DNAs were removed by treatment with 20U Exonuclease I (Epicentre) at 37° C. for 30 minutes. Remaining DNA was purified with ethanol precipitation and quantified with OD260 measurement.

Amplification of gene targets. Three assay regions were tested: One on each of chromosomes 4, 21 and X. The genomic location (fragment starting and ending positions are provided), of the selected fragments are as follows: Chr4 106415806_106416680 (SEQ ID No. 1), Chr21 38298439_38299372 (SEQ ID No. 2), and ChrX 133694723_133695365 (SEQ ID No. 3). The lengths are 875, 934 and 643 bases respectively. The circularized DNA was amplified with gene specific primers (SEQ ID Nos. 4-9) in a multiplex inverse PCR reaction. PCR primers were picked using Primer3 (available from the FRODO web site hosted by MIT) to yield amplicons ranging between 121 and 168 bp. PCR was carried out with 1× TITANIUM Taq PCR buffer (Clontech), 0.3 mM dNTPs, 0.4 µM each primer, 1× TITANIUM Taq DNA Polymerase (Clontech), and ~200 ng of the circularized DNA. After denaturation at 94° C. for 2 minutes, reactions were cycled 30 times as follows: 94° C. for 20 seconds, 60° C. for 20 seconds, and 68° C. for 20 seconds, with a 68° C. final hold for 4 minutes. PCR products were assessed on a 4-20% gradient polyacrylamide gel (Invitrogen) and precipitated with ethanol.

The amplified DNA was fragmented with DNase I, end-labeled with Biotin, and hybridized to a whole-genome tiling array which spans the entire non-repetitive portion of the genome with uniform coverage at an average probe spacing of ~200 nt (see Matsuzaki et al., *Genome Biol* 10, R125 (2009) and Wagner et al. *Systematic Biology* 43, 250(1994)). Probe intensity ("Array Intensity") from the whole-genome tiling array (y-axis) is grouped into 200 nt bins by the length of the BamHI fragment on which it resides. High probe intensity demonstrates the amplification of fragments in the 600 bp~ 1.2 kb size range (x-axis, log-scale). The computed size distribution of BamHI restricted fragments in the reference genome sequence (NCBI Build 36) is shown by the curve labeled "Number of Fragments". After circularization of the amplified products to obtain circles 1909, three test target fragments were isolated using gene-specific PCR; one on each of chromosomes X, 4, and 21, and prepared for detection.

The three labeled targets were counted using two sampling techniques: DNA microarrays and next-generation sequencing. For the array counting, a custom DNA array detector capable of distinguishing the set of labels bound to the targets was constructed by dedicating one array element for each of the 960 target-label combinations. Each array element consists of a complementary target sequence adjacent to one of the complements of the 960 label sequences (as shown in FIG. 3).

Array Design: For each gene target assayed, the array probes tiled consist of all possible combinations of the 960 counter sequences connected to the two BamHI genomic fragment ends (FIG. 8). An additional 192 counter sequences that were not included in the adaptor pool were also tiled to serve as non-specific controls. This tiling strategy enables counter detection separately at each paired end, since each target fragment is ligated to two independent counters (one on either end).

Arrays were synthesized following standard Affymetrix GENECHIP manufacturing methods utilizing lithography and phosphoramidite nucleoside monomers bearing photolabile 5'-protecting groups. Array probes were synthesized with 5' phosphate ends to allow for ligation. Fused-silica wafer substrates were prepared by standard methods with trialkoxy aminosilane as previously described in Fodor et al., *Science* 251:767 (1991). After the final lithographic exposure step, the wafer was de-protected in an ethanolic amine solution for a total of 8 hrs prior to dicing and packaging.

Hybridization to Arrays: PCR products were digested with Stu I (NEB), and treated with Lambda exonuclease (USB). 5 µg of the digested DNA was hybridized to a GeneChip array in 112.5 µl of hybridization solution containing 80 µg denatured Herring sperm DNA (Promega), 25% formamide, 2.5 pM biotin-labeled gridding oligo, and 70 µl hybridization buffer (4.8M TMACl, 15 mM Tris pH 8, and 0.015% Triton X-100). Hybridizations were carried out in ovens for 16 hours at 50° C. with rotation at 30 rpm. Following hybridization, arrays were washed in 0.2×SSPE containing 0.005% Trition X-100 for 30 minutes at 37° C., and with TE (10 mM Tris, 1 mM EDTA, pH 8) for 15 minutes at 37° C. A short biotin-labeled oligonucleotide (see 3119 in FIG. 8) was annealed to the hybridized DNAs, and ligated to the array probes with *E. coli* DNA ligase (USB). Excess unligated oligonucleotides were removed with TE wash for 10 minutes at 50° C. The arrays were stained with Streptavidin, R-phycoerythrin conjugate (Invitrogen) and scanned on the GCS3000 instrument (Affymetrix).

Figure 22:
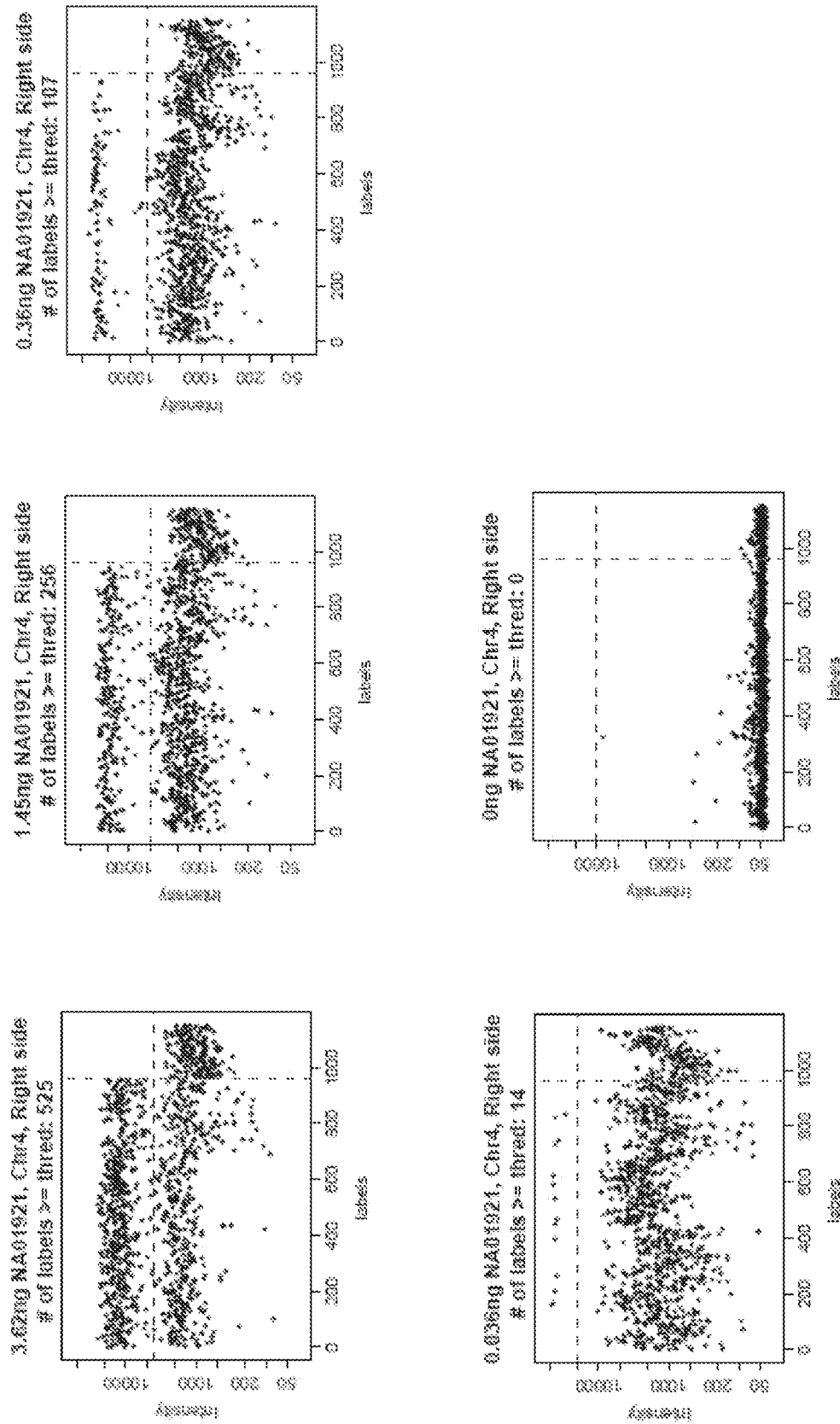
FIG. 22 shows labels observed by microarray hybridization plotted against intensity (y-axis) for each of 960 labels for the Chr 4 gene target.
Figure 23:
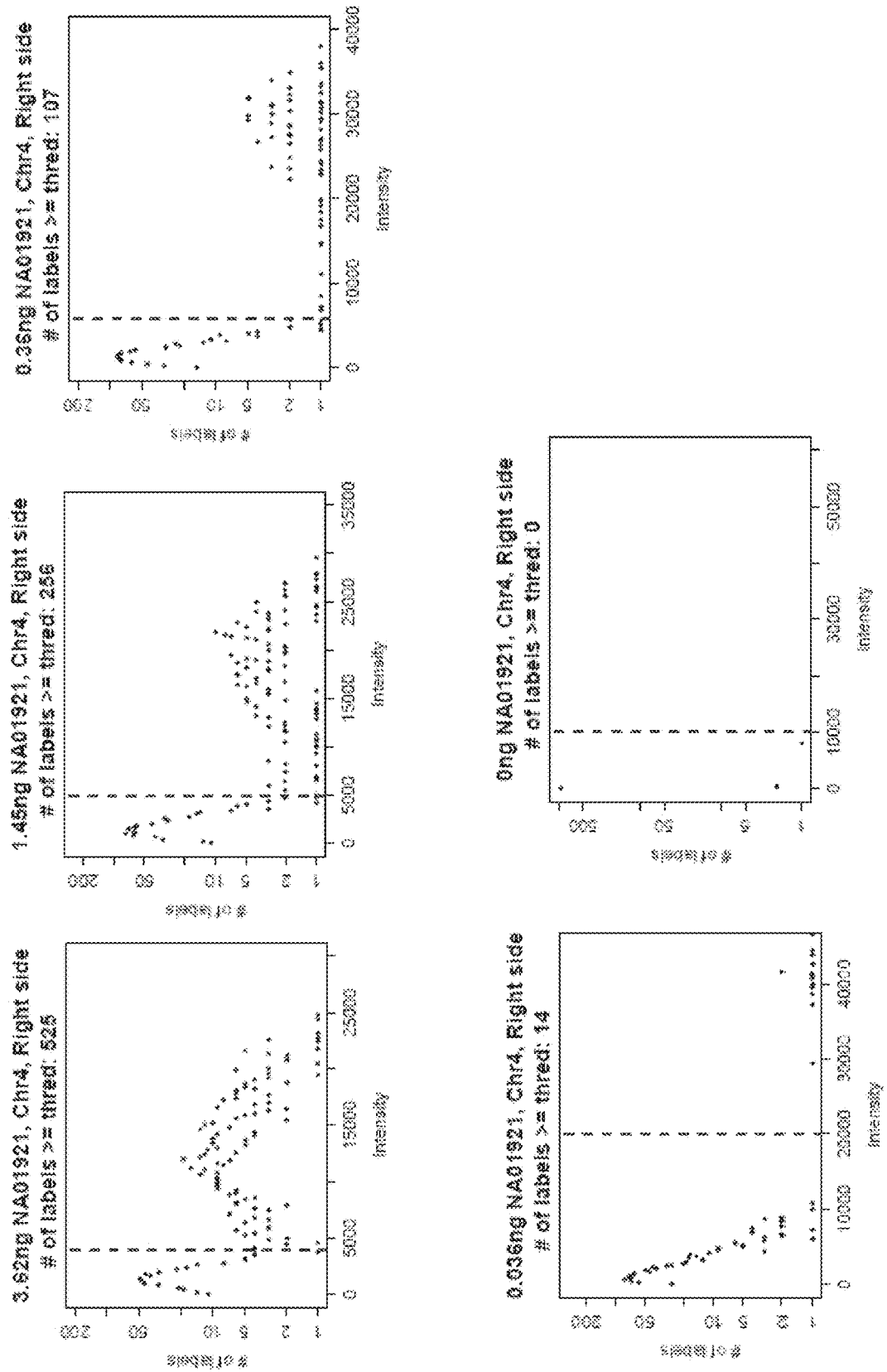
FIG. 23 shows frequency plots (y-axis, log-scale) of intensity distributions of the 960 labels in the microarray experiments with the counting threshold applied indicated by the dashed line.
Figure 29:
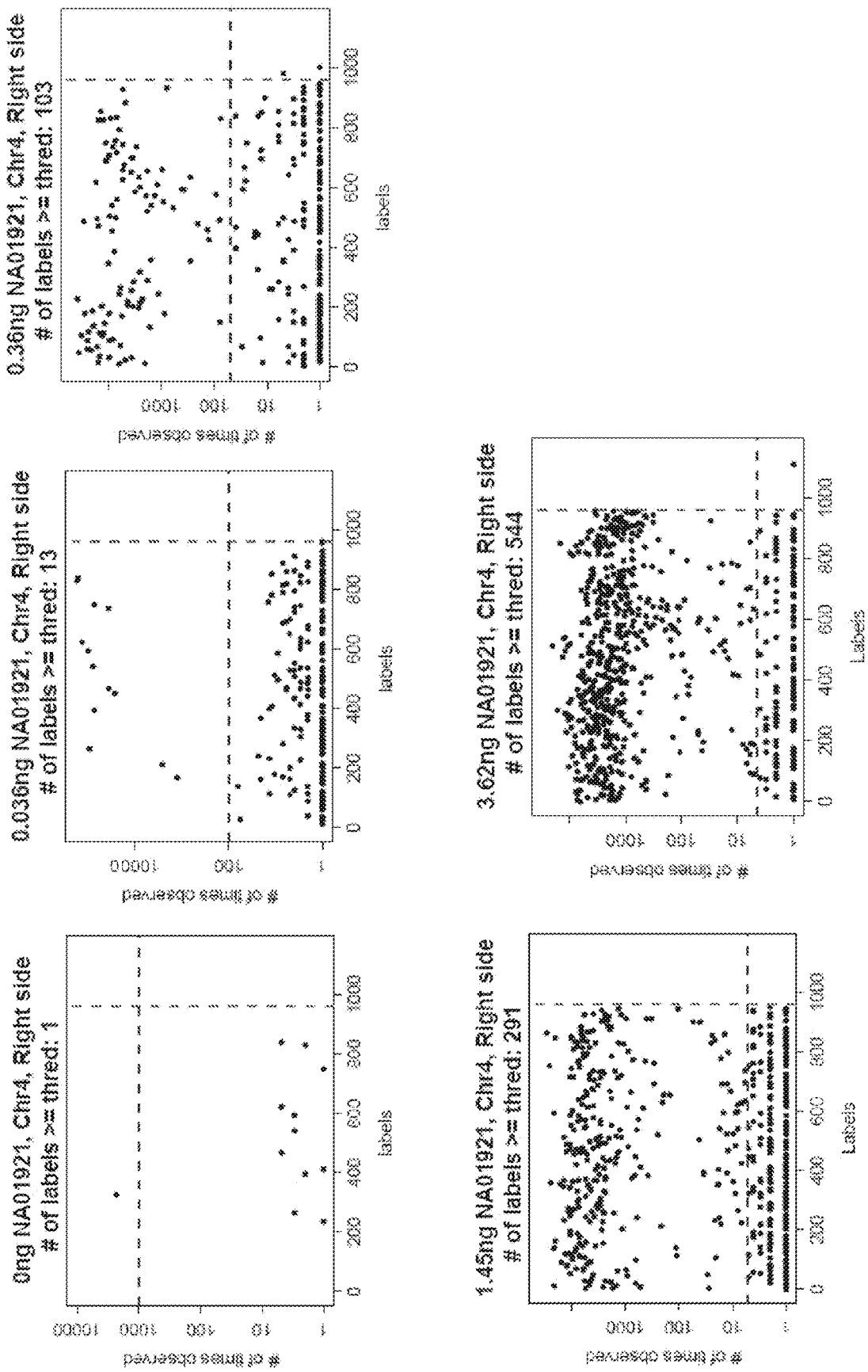
FIG. 29 shows plots of labels observed in the mapped reads from the first sequencing run for chromosome 4 with the horizontal dashed line indicating the counting threshold applied and the vertical dashed line indicating the break separating the 192 negative controls from the expected labels (controls to the right of the line).

In order to maximize the specificity of target-label hybridization and scoring, we employed a ligation labeling procedure on the captured sequences (FIG. 8). We set thresholds to best separate the intensity data from the array into two clusters, one of low intensity and one of high intensity to classify labels as either being used or not (FIGS. 22, 23 and 29). We score a label as "present" and counted if its signal intensity exceeded the threshold. To count labels we set thresholds for the array intensity, or the number of sequencing reads. Appropriate thresholds were straightforward to determine when used and un-used labels fall into two distinct clusters separated by a significant gap. In situations where a gap was not obvious, the function normalmixEM in the R package mixtools was used to classify labels. This function uses the Expectation Maximization (EM) algorithm to fit the data by mixtures of two normal distributions iteratively. The two normal distributions correspond to the two clusters to be identified. The cluster of labels with a high value is counted as "used", and the other as "not used". The average of the minimum and maximum of the two clusters, $(I_{min}+I_{max})/2$, was applied as the threshold for separating the two clusters.

Sampling error calculation. A sampling error can be introduced when preparing dilutions of the stock DNA solution. This error is a direct consequence of random fluctuations in the number of molecules in the volume of solution sampled. For example, when exactly 10 µl of a 100 µl solution containing 100 molecules is measured, the actual number of molecules in the sampled aliquot may not be exactly 10. The lower the concentration of the molecules in the entire solution, the higher the sampling error, and the more likely the actual abundance in the sampled aliquot will deviate from the expected abundance (n=10). To calculate sampling errors, we determined the number of molecules for each chromosome target in our stock DNA solution and performed numerical simulations to follow our dilution steps in preparing the test samples (3.62 ng, 1.45 ng, 0.36 ng and 0.036 ng). To illustrate, if the dilution step is sampling 1 µl of a 25 µl solution containing 250 molecules, we create 25 bins and randomly assign each of the 250 molecules into one of the bins. We randomly choose one bin and count the number of molecules assigned to that bin to simulate the process of sampling ¹⁄₂₅th of the entire solution. If a serial dilution was performed, we would repeat the simulation process accordingly. For each dilution, the observed copy number ratios of Chr 4:X or 21:X for 10,000 independent trials are summarized as observed medians, along with the $10^{th}$ and $90^{th}$ percentiles and shown in FIGS. 12 and 13.

Figure 10:
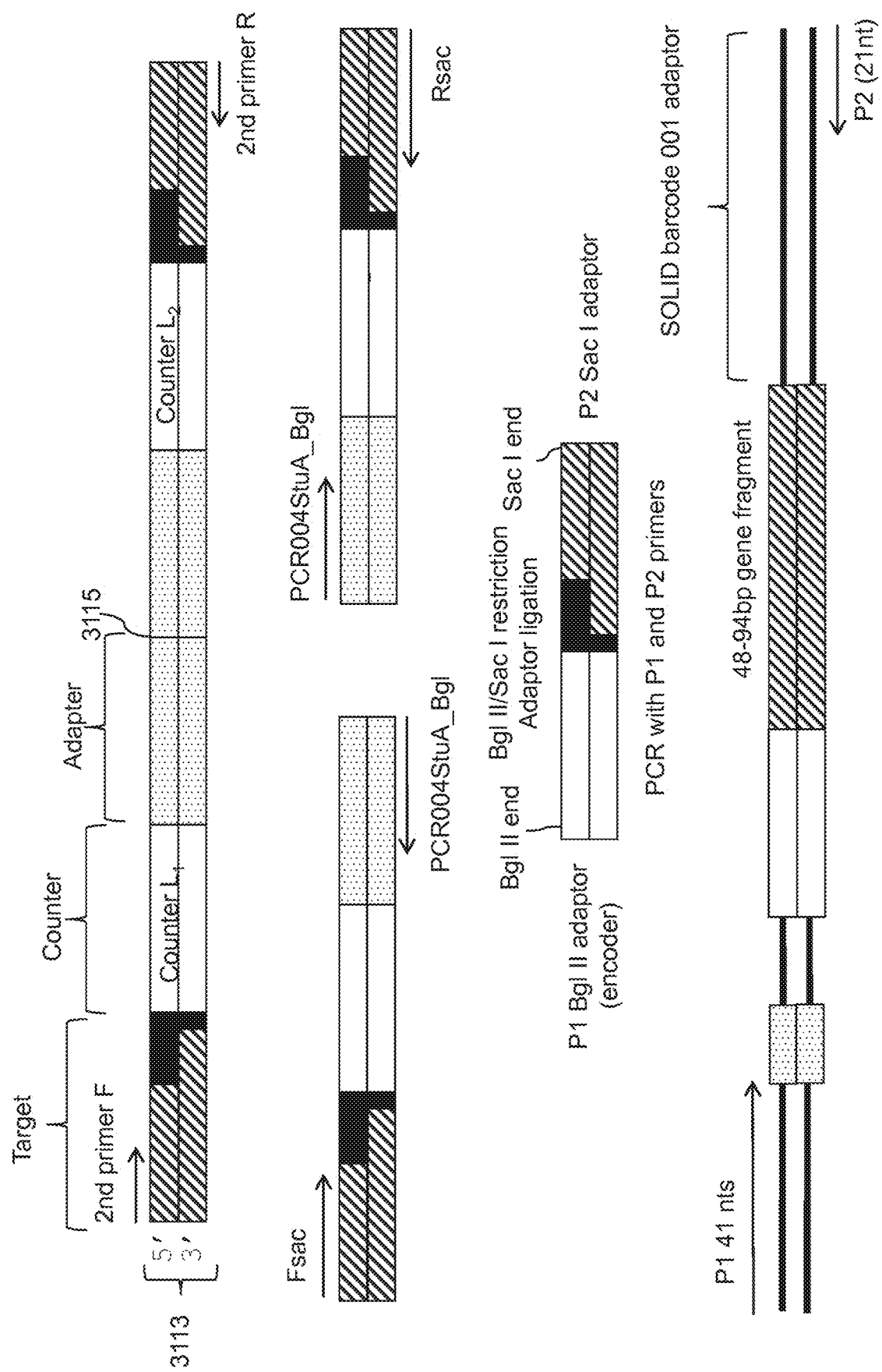
FIG. 10 shows the arrangement of the adaptors, labels and primers used to convert the labeled sample into sequencing template.

As an alternate form of detection, the samples were submitted to two independent DNA sequencing runs (FIG. 10). The arrangement and position of the adaptors and PCR primers used to convert the DNA sample hybridized to microarrays into sequencing templates are shown in the figure. The circularized junction 3115 is located between the two counter labels. PCR primers that have restriction sites are used to amplify two fragments. The fragments are digested with the restriction enzymes to generate ends compatible with ligation to sequencing adaptors. The sequencing adaptors are ligated to the ends to generate a fragment that has the label sequence and a portion of the target that is 48 to 94 base pairs in length are flanked by sequences for use with SOLID sequencing.

Validation by DNA sequencing (First SOLID run). DNA targets that were used for hybridization to arrays were converted to libraries for sequencing on the SOLID instrument (ABI). P1 and P2 SOLID amplification primers were added to the DNA ends through adaptor ligation and strand extension from gene-specific primers flanked by P1 or P2 sequences (FIG. 10). Each sample received a unique ligation adaptor harboring a 4-base encoder (SEQ ID Nos. 34-43) that unambiguously identifies the originating sample of any resulting read. Each adaptor includes two strands, SEQ ID Nos. 34 and 35, 36 and 37, 38 and 39, 40 and 41 or 42 and 43, that hybridize to form a double stranded region of 29 base pairs and a single stranded 4 base overhang (GATC). Individual libraries were prepared for each sample, and quantified with picogreen before equal amounts of each sample was combined into a single pooled library. DNA sequencing was performed on SOLID v3 by Cofactor Genomics. A total of ~46 million 50 base reads were generated. Each read is composed of three segments, corresponding to the sample encoder, label sequence and gene fragment (FIG. 10). We removed reads if: uncalled color bases were present, the average Quality Value (aQV) of the whole read<10, the aQV of the sample encoder<20, or the aQV of the label sequence<18. 40% of the raw reads were removed. Filtered reads were mapped to reference sequences using the program Short Oligonucleotide Color Space (SOCS), available from ABI with a maximum tolerance of 4 color mismatches between the first 45 color bases in each read and reference sequences (the last 5 color bases on 3' end of each read were trimmed in alignment). About 64.3% reads were uniquely mapped to reference sequences, of which 89.5% (16 million) have high mapping quality, i.e., with no mismatch in the sample encoder and at most 1 mismatch in the label sequence. These high-quality reads, accounting for ~35% of the total reads generated, were used in subsequent counting analysis.

Sequencing replication (Second SOLID run). An aliquot of the exact same DNA library originally sequenced by Cofactor Genomics was subsequently re-sequenced by Beckman Coulter Genomics. Approximately 50 million 35 base reads were generated, and processed following the same rules. Approximately 61% of the raw reads passed quality filters, of which 81% uniquely mapped to a reference sequence with a maximum tolerance of 3 color mismatches (An adjusted mismatch tolerance was applied in the alignment step to account for the shorter length of these reads). Of the mapped reads, 91% (22.5 million) are of high mapping quality, i.e., with perfect match in the sample encoder and at most 1 mismatch in the label sequence. These high-quality reads (45% of the total raw reads generated) were used for counting analysis.

Between several hundred thousand to several million reads were used to score the captured labels. Table 1 shows the number of mapped reads from SOLID DNA sequencing.

Figure 4:
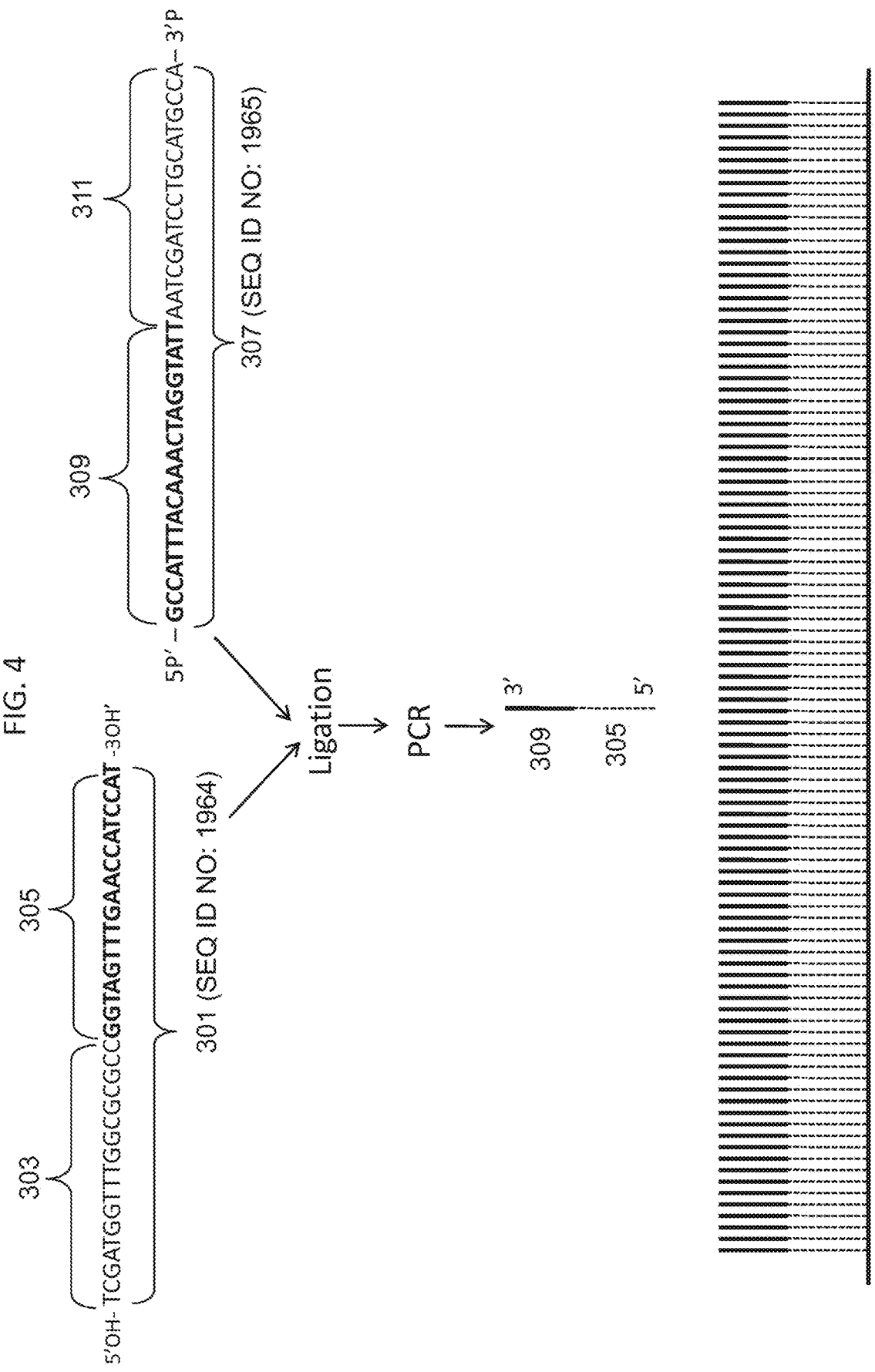
FIG. 4 shows a schematic of a method for detection of ligation products by hybridization to array probes that are complementary to the sequence resulting from the ligation.

We set thresholds for the number of sequencing reads observed for each label, and score a label as "present" and counted if the number of sequencing reads exceeded the threshold. Label usage summaries from experimental observations or from the stochastic modeling are shown in Table 2. The number of attached labels, k, detected for each target in each dilution either by microarray counting or sequence counting is presented in Table 2, and plotted in FIGS. 4 and 5.

Figure 12:
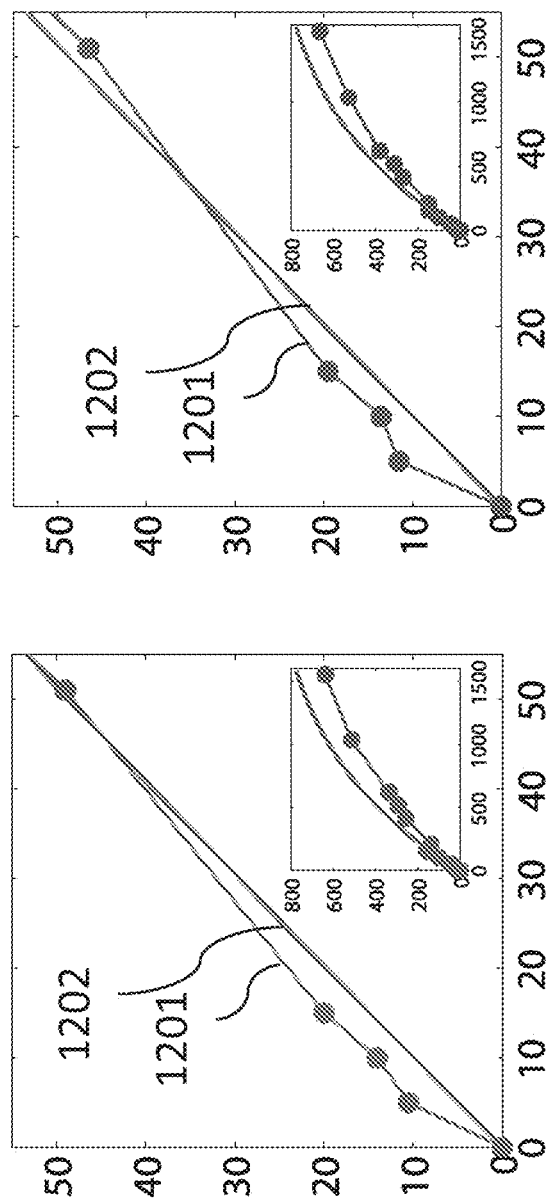
FIG. 12 is a plot of counting results for 4 different DNA copy number titrations using microarray hybridization (on left) or DNA sequencing in (on right).
Figure 13:
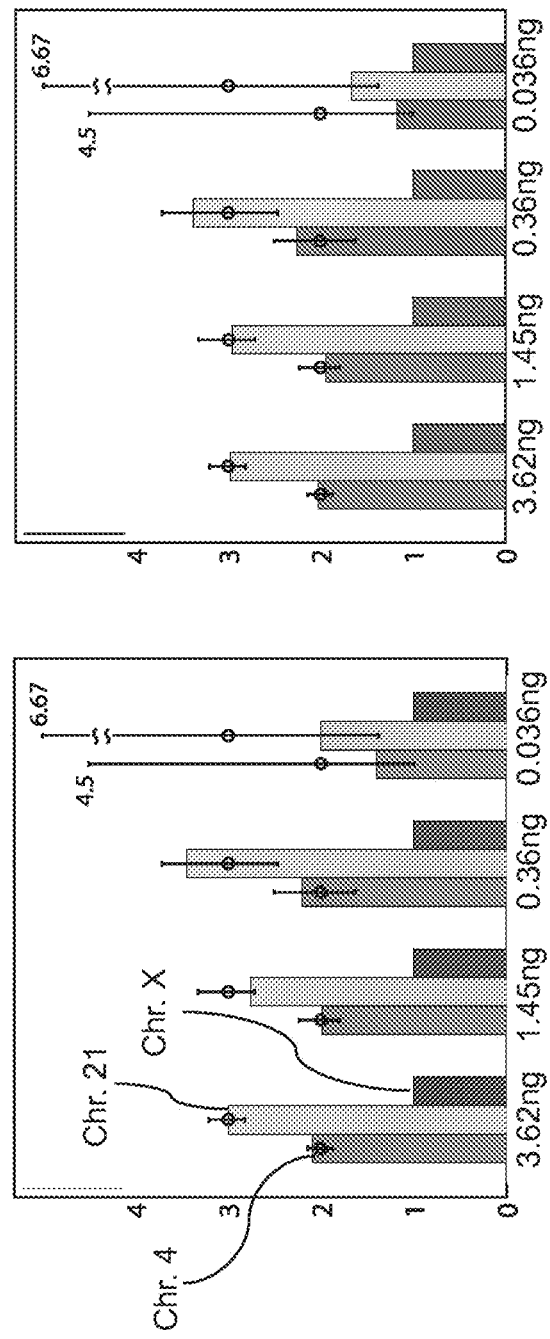
FIG. 13 shows relative copy ratios of three tested gene targets representing copy number 1, 2 or 3 at different dilutions as analyzed using the disclosed methods.

Several dilutions (3.62 ng, 1.45 ng, 0.36 ng and 0.036 ng) of DNA isolated from cultured of a Trisomy 21 male individual were processed for microarray hybridization (FIG. 12 left) and DNA sequencing (FIG. 12 right). Three gene targets were tested from chromosome X, 4 and 21, and observed numbers of detected labels are shown ("observed"). The number of target molecules for each sample was determined from the amount of DNA used, assuming a single haploid nucleus corresponds to 3.5 pg. For comparison, the calculated number of labels expected to appear using a stochastic model are also plotted ("calculated"). Numerical values are provided in Table 4. Relative copy ratios of the three gene targets (FIG. 13): ChrX (right bar), Chr4 (left bar) and Chr21 (center bar) representing one, two and three copies per cell, respectively. Different dilutions (3.62 ng, 1.45 ng, 0.36 ng and 0.036 ng) of the DNA isolated from cultured lymphoblasts of a Trisomy 21 male individual were processed for microarray hybridization and DNA sequencing. The calculated number of target molecules was determined from the number of labels detected on microarrays (Table 4, column 9) or from the SOLiD sequencing data. For each sample dilution, the copy number ratio of each gene target relative to ChrX is shown for Microarray (FIG. 13 left) and SOLiD sequencing (FIG. 13 right). For comparison, relative copy ratios obtained from in silico sampling simulations are also shown in (FIG. 13 left) and (FIG. 13 right), where circles indicate the median values from 10,000 independent trials and error bars indicate the 10th and 90th percentiles. The 90th percentile values of the relative copy ratios at the lowest concentration (0.036 ng) are explicitly labeled in the plots.

TABLE 2

| DNA sample | | 3.62 ng | 1.45 ng | 0.36 ng | 0.036 ng | 0 ng |
|---|---|---|---|---|---|---|
| Chr4 | Stochastic Model | 633 | 336 | 98 | 10 | 0 |
| Left side | Microarray | 501 | 260 | 102 | 14 | 0 |
| | 1st SOLID run | 513 | 251 | 101 | 14 | 0 |
| | 2nd SOLID run | 516 | 273 | 102 | 14 | 0 |
| Right side | Array | 525 | 256 | 107 | 14 | 0 |
| | 1st SOLID run | 544 | 291 | 103 | 13 | 1 |
| | 2nd SOLID run | 557 | 307 | 103 | 13 | 1 |

TABLE 1

| DNA sample | | | 5 ng | 2 ng | 0.5 ng | 0.05 ng | 0n g |
|---|---|---|---|---|---|---|---|
| Chr4 | Left side | 1st SOLID run | 709,076 | 252,211 | 237,380 | 316,629 | 1,204 |
| | | 2nd SOLID run | 621,372 | 73,962 | 189,937 | 237,520 | 411 |
| | Right side | 1st SOLID run | 1,724,955 | 1,662,958 | 1,114,246 | 2,201,078 | 3,353 |
| | | 2nd SOLID run | 1,422,673 | 1,359,512 | 839,775 | 980,616 | 2,386 |
| Chr21 | Left side | 1st SOLID run | 1,615,416 | 1,474,208 | 832,234 | 1,428,540 | 1,851 |
| | | 2nd SOLID run | 1,296,685 | 1,038,456 | 622,429 | 930,461 | 840 |
| | Right side | 1st SOLID run | 1,124,772 | 886,421 | 551,192 | 849,204 | 821 |
| | | 2nd SOLID run | 910,298 | 522,358 | 367,207 | 479,621 | 224 |
| ChrX | Left side | 1st SOLID run | 444,960 | 316,975 | 254,386 | 515,213 | 744 |
| | | 2nd SOLID run | 266,606 | 157,860 | 137,706 | 220,121 | 5 |
| | Right side | 1st SOLID run | 1,227,047 | 921,214 | 777,033 | 1,064,531 | 64 |
| | | 2nd SOLID run | 1,043,475 | 768,296 | 559,038 | 695,873 | 43 |

TABLE 2-continued

| | DNA sample | | 3.62 ng | 1.45 ng | 0.36 ng | 0.036 ng | 0 ng |
|---|---|---|---|---|---|---|---|
| Chr21 | Stochastic Model | | 769 | 457 | 143 | 15 | 0 |
| | Left | Microarray | 651 | 335 | 160 | 20 | 0 |
| | side | 1st SOLID run | 678 | 381 | 152 | 20 | 0 |
| | | 2nd SOLID run | 665 | 358 | 161 | 18 | 0 |
| | Right | Microarray | 627 | 341 | 157 | 20 | 0 |
| | side | 1st SOLID run | 650 | 381 | 146 | 19 | 0 |
| | | 2nd SOLID run | 653 | 379 | 146 | 19 | 0 |
| ChrX | Stochastic Model | | 400 | 186 | 50 | 5 | 0 |
| | Left | Microarray | 281 | 148 | 50 | 11 | 0 |
| | side | 1st SOLID run | 290 | 149 | 43 | 11 | 0 |
| | | 2nd SOLID run | 300 | 150 | 45 | 11 | 0 |
| | Right | Microarray | 306 | 133 | 48 | 10 | 1 |
| | side | 1st SOLID run | 336 | 153 | 50 | 12 | 0 |
| | | 2nd SOLID run | 344 | 167 | 43 | 11 | 0 |

The counting results span a range of approximately 1,500 to 5 molecules, and it is useful to consider the results in two counting regimes, below and above 200 molecules. There is a striking agreement between the experimentally observed number of molecules and that expected from dilution in the first regime where the ratio of molecules to labels (n/m)<0.2 (Table 2). Below 200 molecules the data are in tight agreement, including the data from the lowest number of molecules, 5, 10 and 15 where the counting results are all within the expected sampling error for the experiment (The sampling error for 10 molecules is estimated to be 10±6.4, where 10 and 6.4 are the mean and two standard deviations from 10,000 independent simulation trials).

In the second regime above 200 molecules, there is an approximate 10-25% undercounting of molecules, increasing as the number of molecules increases. We attribute this deviation to be due to a distortion in the amplification reaction. PCR-introduced distortion occurs from small amounts of any complex template due to the differences in amplification efficiency between individual templates (2, 3). In the present case, stochastic labeling will produce only one (at low n m ratios), and increasingly several copies (at higher n m ratios) of each template. Modeling suggests that simple random dropout of sequences (PCR efficiencies under 100%) generate significant distortion in the final numbers of each molecule after amplification. At any labeling ratio, random dropout of sequences due to PCR efficiency will result in an undercount of the original number of molecules. At high n m ratios, the number of labels residing on multiple targets will increase and have a statistical survival advantage through the PCR reaction causing greater distortion. In support of this argument, we observe a wide range of intensities on the microarray and a wide range in the number of occurrences of specific sequences in the sequencing experiments (FIGS. 23, 29). This effect can be reduced by carrying out the reaction at n m ratios near or less than 0.2, increasing the number of labels m, further optimization of the amplification reaction, or by employing a linear amplification method. Other factors, such as errors from inaccurate pipetting, could also contribute.

The lymphoblast cell line used in this study provides an internal control for the relative measurement of copy number for genes residing on chromosomes X, 4 and 21. FIG. 13 presents the relative number of molecules from all three chromosomes normalized to copy number 1 for the X chromosome. As shown, the measurements above 50 molecules all yield highly precise relative copy number values. At low numbers of molecules (0.036 ng), uncertainty results because the stochastic variation of molecules captured by sampling an aliquot for dilution are significant. Numerical simulations were performed to estimate the sampling variation, and summarized medians, along with the $10^{th}$ and $90^{th}$ percentiles of the copy number ratios and are shown in FIGS. 12 and 13 as circles and range bars, respectively. At the most extreme dilutions, where ~5, 10, and 15 molecules are expected for the chromosome X, 4 and 21 genes, the copy number ratios fall within the expected sampling error.

Overall, the identity of labels detected on the microarrays and in sequencing are in good agreement, with only a small subset of labels unique to each process (Table 7). Despite a high sequencing sampling depth (Table 1), a small number of labels with high microarray intensity appear to be missing or under-represented in the sequencing results. In contrast, labels that appear in high numbers in the sequencing reaction always correlate with high microarray intensities. No trivial explanation could be found for the labels that are missing from any given sequencing experiment. While under-represented in some experiments, the same labels appear as present with high sequence counts in other experiments, suggesting that the sequences are compatible with the sequencing reactions.

PCR validation. We used PCR as an independent method to investigate isolated cases of disagreement, and demonstrated that the labels were present in the samples used for the sequencing runs.

PCR was used to detect the presence of 16 label sequences (Table 3) which were either observed as high or low hybridization intensity on microarrays, and observed with either high or low numbers of mapped reads in SOLID sequencing. The Chr4 gene target was PCR amplified with 3 dilutions (0.1 pg, 1 pg, and 10 pg) of the 3.62 ng NA01921 sample, using the DNA target that was hybridized to microarrays, or the prepared SOLID library template. PCR products were resolved on 4% agarose gels and fluorescent DNA bands were detected after ethidium bromide staining

TABLE 3

| Label ID | Label Sequence | 1st SOLID reads | 2nd SOLID reads | Microarray intensity | Microarray target template | SOLID library template |
|---|---|---|---|---|---|---|
| 112 | AGATCTTGTGTCCG | 0 | 2 | 15,907 | 1 | 2 |
| 182 | ATCTTCGACACTGG | 0 | 1 | 10,304 | 3 | 4 |
| 779 | TCGAGATGGTGTTC | 0 | 4 | 9,411 | 5 | 6 |
| 782 | TCGGATAGAGAGCA | 0 | 0 | 6,716 | 7 | 8 |
| 783 | TCGGTACCAACAAC | 1 | 4 | 13,132 | 9 | 10 |
| 290 | CCAAGGTTTGGTGA | 1 | 17 | 10,777 | 11 | 12 |

TABLE 3-continued

| Label ID | Label Sequence | 1st SOLID reads | 2nd SOLID reads | Microarray intensity | Microarray target template | SOLID library template |
|---|---|---|---|---|---|---|
| 780 | TCGCAAGAGGTAAG | 1 | 1 | 8,915 | 13 | 14 |
| 570 | GGAGTTACGGCTTT | 1 | 2 | 8,252 | 15 | 16 |
| 741 | TCAACCAGTAAGCC | 794 | 400 | 466 | 17* | 18* |
| 424 | CTGTAAACAACGCC | 1,191 | 1,292 | 527 | 19* | 20* |
| 242 | CACGATAGTTTGCC | 905 | 781 | 1,103 | 21* | 22 |
| 859 | TGTACTAACACGCC | 920 | 892 | 1,107 | 23* | 24* |
| 83 | ACGCTAACTCCTTG | 8,629 | 7,704 | 19,500 | 25 | 26 |
| 383 | CGTTTACGATGTGG | 7,278 | 6,402 | 19,022 | 27 | 28 |
| 804 | TCTTAGGAAACGCC | 0 | 0 | 70 | 29* | 30* |
| 834 | TGCAATAGACGACC | 0 | 1 | 72 | 31* | 32* |

Table 3. PCR detection for the presence of label sequences in the processed DNA sample that was hybridized to microarray, or in the DNA sequencing library. Each PCR contained 0.1 pg of template, which represents approximately 1×106 DNA molecules. The number of mapped sequencing reads and the microarray intensity of each of the 16 labels for this selected gene target (Chr4, 3.62 ng) are listed. The last 2 columns show the gel lane number containing the indicated sample. Those numbers indicated by an * correspond to reactions where PCR failed to detect the label sequence in the sample.

Although we can clearly confirm their presence in the sequencing libraries, it is unclear as to why these labels are missing or under-represented in the final sequencing data.

To test the stochastic behavior of label selection, we pooled the results of multiple reactions at low target concentrations (0.36 and 0.036 ng), where the probability that a label will be chosen more than once is small.

Figure 14:
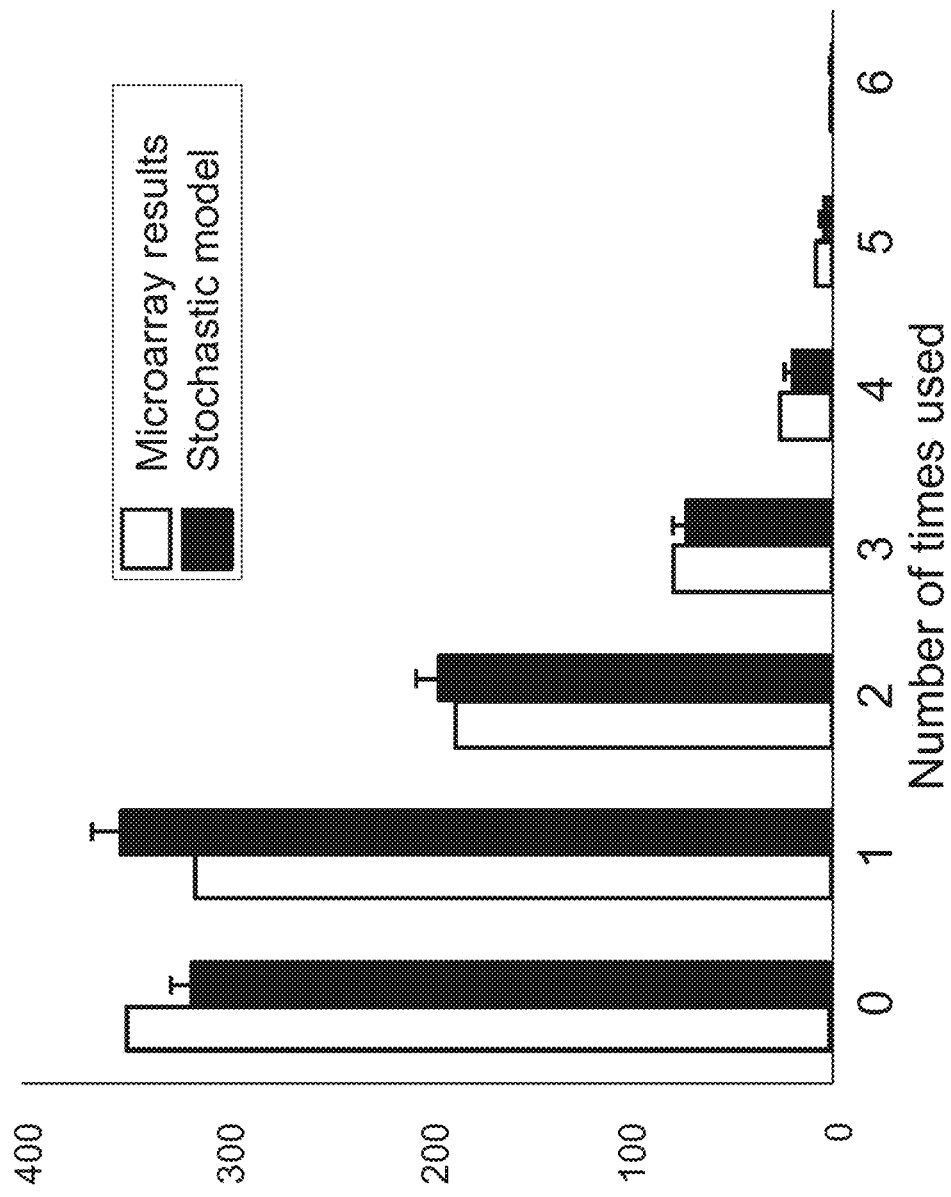
FIG. 14 shows a comparison between experimentally observed label usage with those predicted from stochastic modeling.

FIG. 14 shows that the number of times each label is used closely follows modeling for 1,064 data points obtained from microarray counting. The graph is a comparison between experimentally observed label usage rates (microarray results) with those predicted from stochastic model (stochastic model). At low target molecule numbers, the chance of multiple target ligations to the same label sequence is low. It is therefore reasonable to consider data from experiments with low target numbers (0.036 ng and 0.36 ng of DNA), from those experiments, a total of 1,064 labels were observed, with the total frequency of label usage ranging from 0 to 6. The theoretically expected label usage frequency for 1,064 target molecules was obtained by performing 5000 simulation runs, with multiple independent reactions simulated in each run. The error bars indicate one standard deviation from the corresponding means.

Furthermore, since each end of a target sequence chooses a label independently, we can compare the likely hood of the same label occurring on both ends of a target at high copy numbers. Table 4 columns 10-11 present the experimentally observed frequency of labels occurring in common across both ends of a target and their expected frequency from numerical simulations. No evidence of non-stochastic behavior was observed in this data.

TABLE 4

| Gene target | Genomic DNA amount (ng) | Estimated # of molecules at either end | Expected # of labels at either end | Expected # of labels in common across paired-ends | Microarray observed # of labels | | | # of molecules inferred from microarray observed # of labels | Expected # of labels in common across paired-ends | Microarray observed # of labels in common across paired-ends |
|---|---|---|---|---|---|---|---|---|---|---|
| | | | | | L | R | Avg | | | |
| Chr4 | 3.62 | 1034 | 633 | 417.68 ± 11.35 | 501 | 525 | 513 | 733 | 273.96 ± 10.24 | 303 |
| | 1.45 | 414 | 336 | 117.92 ± 7.83 | 260 | 256 | 258 | 300 | 69.22 ± 6.43 | 63 |
| | 0.36 | 103 | 98 | 9.93 ± 2.81 | 102 | 107 | 104 | 110 | 11.26 ± 2.99 | 20 |
| | 0.036 | 10 | 10 | 0.11 ± 0.32 | 14 | 14 | 14 | 14 | 0.20 ± 0.44 | 0 |
| | 0 | 0 | 0 | 0 | 0 | 0 | 0 | 0 | 0 | 0 |
| Chr21 | 3.62 | 1551 | 769 | 616.74 ± 11.94 | 651 | 627 | 639 | 1051 | 425.28 ± 11.37 | 453 |
| | 1.45 | 620 | 457 | 217.36 ± 9.51 | 335 | 341 | 338 | 416 | 118.79 ± 7.83 | 130 |
| | 0.36 | 155 | 143 | 21.37 ± 3.98 | 160 | 157 | 158 | 172 | 25.86 ± 4.38 | 32 |
| | 0.036 | 15 | 15 | 0.24 ± 0.48 | 20 | 20 | 20 | 20 | 0.40 ± 0.62 | 0 |
| | 0 | 0 | 0 | 0 | 0 | 0 | 0 | 0 | 0 | 0 |
| ChrX | 3.62 | 517 | 400 | 166.63 ± 8.81 | 281 | 306 | 294 | 351 | 90.14 ± 7.08 | 103 |
| | 1.45 | 207 | 186 | 36.26 ± 4.98 | 148 | 133 | 140 | 151 | 20.34 ± 3.94 | 23 |
| | 0.36 | 51 | 50 | 2.58 ± 1.52 | 50 | 48 | 49 | 50 | 2.45 ± 1.51 | 4 |
| | 0.036 | 5 | 5 | 0.03 ± 0.16 | 11 | 10 | 10 | 10 | 0.10 ± 0.31 | 2 |
| | 0 | 0 | 0 | 0 | 0 | 1 | 0 | 0 | 0 | 0 |
| 1 | 2 | 3 | 4 | 5 | 6 | 7 | 8 | 9 | 10 | 11 |

Labels detected on microarray experiments are quantified in Table 4. Indicated quantities (col. 2) of genomic DNA derived from a Trisomy 21 male sample were tested on 3 chromosome targets (col. 1). The estimated number of copies of target molecules (or haploid genome equivalents, col. 3), the number of labels expected by the stochastic model (col. 4), and the actual number of labels detected on microarrays (col. 6-8) are summarized. Because each gene target fragment paired-end consists of random, independent label ligation events at the left (L) and the right (R) termini, the number of identical labels expected (col. 5) can be predicted from computer simulations, and compared to the number actually detected (col. 11). Given the number of labels detected (col. 8), we obtain the corresponding number of copies of target molecules (col. 9) in our stochastic model, and the predicted occurrences of identical labels across paired-ends (col. 10). The numbers in col. 5 and 10 are the means from 5,000 independent simulation runs along with one standard deviation of the corresponding means, given the number of labels at either end (col. 4 and col. 9).

The detailed column information for Table 4 is as follows: column 1: name of tested gene targets; column 2: estimated number of target molecules at either left or right end, this number is determined by PICOGREEN dye measurement (Molecular Probes, Inc.), the DNA concentration is also listed in this column; column 3: number of labels expected to be observed/used at either end (predicted by theoretical models), given the estimated number of target molecules in 2nd column; column 4: number of labels expected to be observed in common across the paired-ends (predicted by theoretical models), given the estimated number of target molecules in 2nd column; column 5: empirically observed number of labels used at the left end of gene target; column 6: empirically observed number of labels used at the right end of gene target; column 7: empirically observed number of labels used in common across the paired-ends; column 8: number of target molecules predicted by theoretical models, based on the empirically observed number of labels used (i.e., number in 7th column); column 9: number of labels expected to be observed in common across the paired-ends, given the number of target molecules in 8th column; column 10: empirically observed number of labels that were used in common across the paired-ends of the gene target.

Example X: An array was designed having 48 target sequences. Each target was paired with one of 3840 labels or "counters" for a total of 48×3840 or 184,320 probes. The probes were 30 mers (30 nucleotides in length) and the assay was designed to test whether or not the 30 mer imparts sufficient discrimination. Of the 30 bases, 15 bases are from the labels and the other 15 bases are derived from the targets. The probes were assayed to determine if each label-target combination hybridizes specifically. A phage RNA ligase was used to join labels with targets. Universal priming sites of 18 bases were included on the 5' end of the labels and the 3' end of the targets, facilitating PCR amplification of the joined label-targets. The method is diagramed in FIG. 3.

The 3840 distinct label oligos (counters) were single stranded oligos pooled from the Ddel TACL primer panel (40 primer plates by 96 wells per plate for 3840 different oligos). An example label oligo 301 is shown (SEQ ID NO: 1964)
5'TCGATGGTTTGGCGCGCCGGTAGTTTGAACCATCCAT-3'.

The 48 different primers used as "targets" were synthesized using as target 48 different 21 nucleotide sequences from the Affymetrix TrueTag 5K_A array. An example target oligo 307 is shown (SEQ ID NO: 1965)
5'GCCATTTACAAACTAGGTATTAATCGATCCTGCATGCC-3'.

The "label" or "counter" oligo has an 18 nt common sequence at the 5' end and a 15-28 nt "label" (or "counter") sequence at the 3' end. An example "label" 305 is shown. The universal primer 303 common to all or a group of the label oligos has sequence (SEQ ID NO: 1966)
5' TCGATGGTTTGGCGCGCC-3' at the 5' end and each target oligonucleotide has common sequence (SEQ ID NO: 1967)
311 5' AATCGATCCTGCATGCCA-3' at the 3' end as universal priming sequence. The target oligos vary in sequence at the 5' ends 309.

A 1:1 dilution of each of the 3840 counters was mixed with various dilutions of each of the 48 target oligos to simulate different expression levels under ligation conditions so that the 5' end of the target oligos can be ligated to the 3' end of the label oligos. In preferred aspects T4 RNA ligase may be used to join the ends of the single stranded oligos. The 5' and 3' ends of the target oligos are phosphorylated and the 5' and 3' ends of the label oligos are hydroxylated. After the ligation the products are amplified by PCR using primers to the universal priming sequences. Only those fragments that have both universal priming sequences 303 and 311 will amplify efficiently.

Each of the 48 target sequences may be tiled with each of the 3,840 counters, resulting in a total number of features on array=48×3,840=184,320. This is the number of different possible combinations of target with label. The product of the ligation and amplification reactions is hybridized to the array. For each target, the number of features that light up is determined and can be compared to the known copy number of each target in the input sample.

To test the digital counting methods, also referred to as stochastic labeling a collection of label-tag sequences was provided. Each has a common 5' universal priming sequence, preferably 15-20 bases in length to facilitate amplification, and a 3' label sequence, preferably 17-21 bases in length. Each type of primer in the collection has the same universal priming sequence but each type has a label sequence that is different from all of the other types in the collection. In one aspect there are about 4,000 to 5,000 different types of label sequences in the collection to be used. For testing the method, a set of 50 target sequences was synthesized. The target sequences each

SEQ ID NO: 1968
(5'GCTAGGGCTAATATC-3', was used in this experiment). Each of the 50 oligo target sequences that were generated has a different 21 base sequence from the GENFLEX array collection of sequences, for example,

SEQ ID NO: 1970
5' GCCATTTACAAACTAGGTATT'3'.

The collection of label-tag oligos and the collection of target oligos was mixed. Various dilutions of the different targets were used in the mixture of targets to simulate a mixed population present at different levels, for example, different expression or copy number levels. T4 RNA ligase was added to ligate the label-tag oligos to the target oligos. There are 5000 different types of label oligos and 50 different types of target oligos so the majority of the target oligos of the same type will be labeled with a type of label oligo that is different from all of the other target oligos of that type. So target oligo type 1, occurrence 1 will be labeled with a label oligo type A (11A) and target oligo type 1, occurrence 2, will be labeled with a different label oligo, label oligo type B (12B). There is a finite and calculable probability that two or more occurrences of the same target type will be labeled with the same label oligo (11A and 12A), but that probability decreases as the number of different types of label oligos increases relative to the number of occurrences of any given type of target.

The ligated target/label oligos are then amplified using primers to the universal priming sites. Labels can be incorporated during amplification. The labeled amplification product is then hybridized to an array. For each different possible combination of target (50) and label (5000) there is a different probe on the array that targets that junction of the target ligated to the label. There will therefore be 50×5000 different probes on the array or 250,000 different probes.

Scanned images of the 48×3840 array were analyzed and compared to expected results. A total of 8 of the 48 targets were ligated to a pool of 3840 labels (counters). The assay was as shown in FIG. 3. The conditions were single strand deoxyoligonucleotide ligation using a phage RNA ligase to join the labels with targets. Universal priming sites on the targets and labels were included to enable PCR amplification of the joined label-targets. The ligation conditions were essentially as described in (Tessier, D. C. et al. (1986) *Anal Biochem.* 158, 171-178, 50 mM Tris-HCl, pH 8, 10 mM MgCl2; 10 µg/mL BSA, 25% PEG, 1 mM HCC, 20 uM ATP; 5:1 acceptor (labels) to donor (the 8 targets) ratio at 25° C. overnight. The products were amplified using PCR, purified, biotin labeled with TdT, hybridized to the array, washed, stained, and scanned. The expected 8 blocks show hybridization to the array in the expected patterns.

Different ligation conditions were also tested by ligating either a single target or a pool of 48 targets to the 3,840 counters. The concentrations of the targets used in the experiment were high as in the previous experiment so most counters will be ligated to targets. In ligation 1 a single target was ligated to 3,840 labels. In ligation 2, 48 targets at 1:1 copy number were ligated to 3,840 labels. Ligation 3 is a negative control for PCR so no DNA was added. PCR with the pair of universal primers was performed using the ligation products as template and the products separated on a gel. As expected a band was observed from ligations 1 and 2, but not 3. The PCR products were labeled and hybridized to the array and the scan images after array hybridization were analyzed. As expected no signal was observed for ligation 3, all of the targets were observed for ligation 2 and the single expected target was observed for ligation 1. The single target lights up in the correct region of the chip, but background signal was also observed in unexpected locations. Increased stringency of hybridization conditions can be used to minimize hybridization to unexpected probes of the array.

In another example, conditions for optimization of hybridization to decrease cross hybridization were tested. The products used were as described above and hybridization was performed with formamide and with or without non-specific competitor (herring sperm DNA). The non-specific signal is significantly decreased in the presence of formamide, with and without non specific competitor. This demonstrates that even though the targets and counters alone have 15 bases of complementarity to probes on the array, the combination of target plus counter and the resulting increase to 30 bases of complementarity to the probes, results in specific hybridization. Within the block of 3,480 probes, there is heterogeneity in the hybridization intensity. Preliminary sequence analysis shows a strong correlation of GC content with high signals. To minimize this array probes may be selected to have similar melting temps for the counters or the target-counter combination may be optimized to obtain similar hybridization stabilities. For example, if two targets are to be analyzed the portions of each target that are to be part of the probe may be selected to have similar TMs.

To test the efficiency of T4 RNA ligase in the ligation of labels to targets, DNA ligase from *E. coli* was tested. This required a slight modification of the sample prep (as depicted in FIG. 7) by creating an overhang site for duplex ligation. The target in this example has a double stranded target specific portion and a single stranded overhang. The overhang may be, for example, a run of inosine bases, for example 6 to 9, or a string of random bases, for example, N6-16. DNA ligase is used to close the gap and generate a ligated product that includes the target strand and a label/counter from the pool of 3,840 counters. The PCR is carried out in the same manner as above using common primers.

The expected targets were observed, but some non-specific bands were also detected in the amplified DNA, even in the absence of the target. This suggests that the some of the 3,840 labels are combining with each other when this method is used. Selection of an optimized pool of labels may be used to mitigate such interference.

In another example random primed PCR was tested. Instead of a ligation step, the targets have a 3' random region, that can be, for example, a degenerate region or an inosine region. The labels hybridize to the random region and the random region is used as a primer for extension through the label during the PCR step to append a copy of the label and the universal priming site at the 5' end of the label oligo to the 3' end of the target. The extended target has a copy of the label sequence and the universal priming sequence and can be amplified by PCR.

In another example, a purification method for removing excess un-ligated counters was tested. The method is shown schematically in FIG. 11. The counters 101 and the targets 2103 are ligated to form counter-target molecules as shown previously. A support bound probe that is complementary to the universal primer at the end of the target oligonucleotides 2105, is used to separate counter-targets and targets from un-ligated counters. The support 2109 may be, for example, a magnetic bead. A second separation can be used to separate counter-targets from un-ligated targets. The second separation uses a support bound probe complementary to the universal priming sequence at the end of the counters 2107. The single capture reduces background amplification. A double round of capture may also be used.

Figure 18:
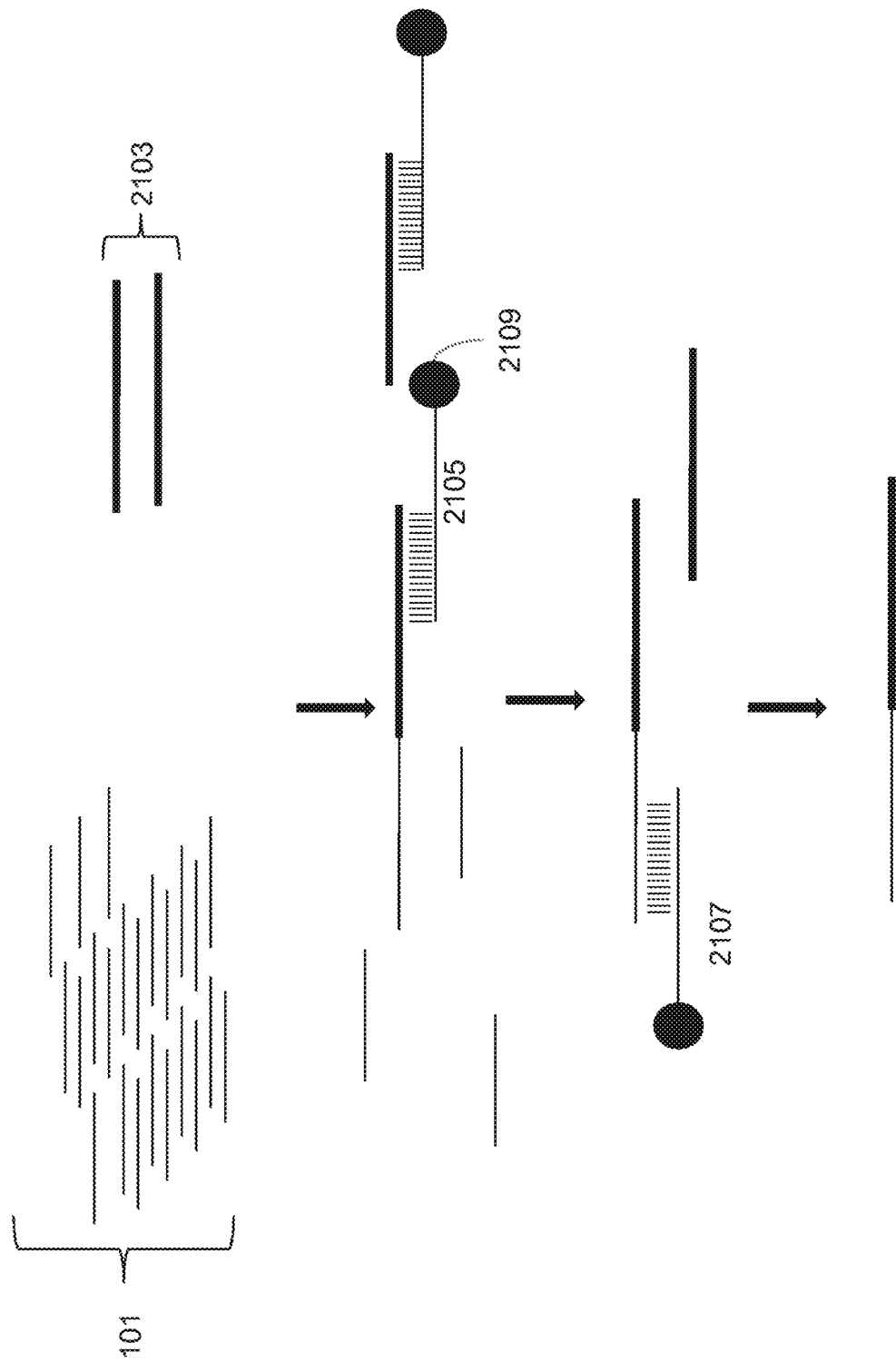
FIG. 18 shows a schematic of a method for enriching for molecules that contain labels, target or both.

In FIG. 18 a scatter plot is shown to illustrate one way of representing the combinations of different target occurrences ligated randomly to different labels in the set. The plot shows combinations for 20 different target occurrences (labeled 1 to 20) representing 20 copies of the same target. The Y-axis represents different labels identified by a number from 1 to 1000. Each of the targets can be labeled with any of the 1000 labels, for example target 1 is labeled with label 351 and has coordinates (1, 351). The labels are distinct and distinguishable while the targets are the same in this example.

Figure 19:
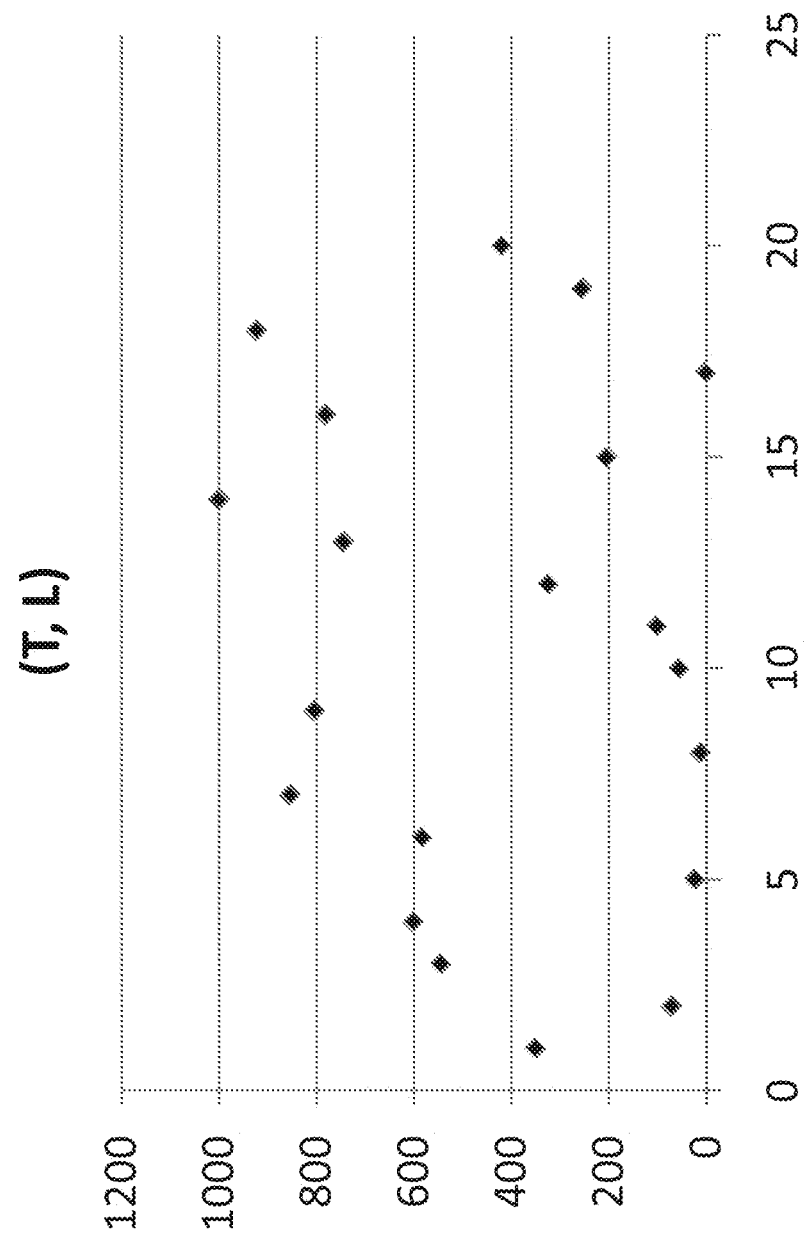
FIG. 19 shows a scatter plot of a series of different target plus label combinations.

FIG. 19 shows a schematic where genomic DNA 1901 is fragmented, for example at restriction sites 1903 to produce fragments 1905. The fragments are ligated with labels to form fragments labeled at both ends 1907. All fragments can be ligated to the labels The label-ligated fragments are circularized, for example, by ligation of the label ends to form closed circles 1909 with first and second labels forming a single label 1911. The circularized fragments can be treated with exonuclease to remove unligated fragments. The circle and label can be amplified using gene-specific PCR primers 1913. The PCR product has the label region 1911 flanked by target specific regions. The array probe is preferably complementary to the junction between the target specific region and the label. There are two such junctions 1915 and 1917 in the PCR product and each could be targeted on either strand (since the product is double stranded). The products may be fragmented, labeled and hybridized to an array of probes to the junctions. The label-target combination can be hybridized to an array for counting.

Figure 20:
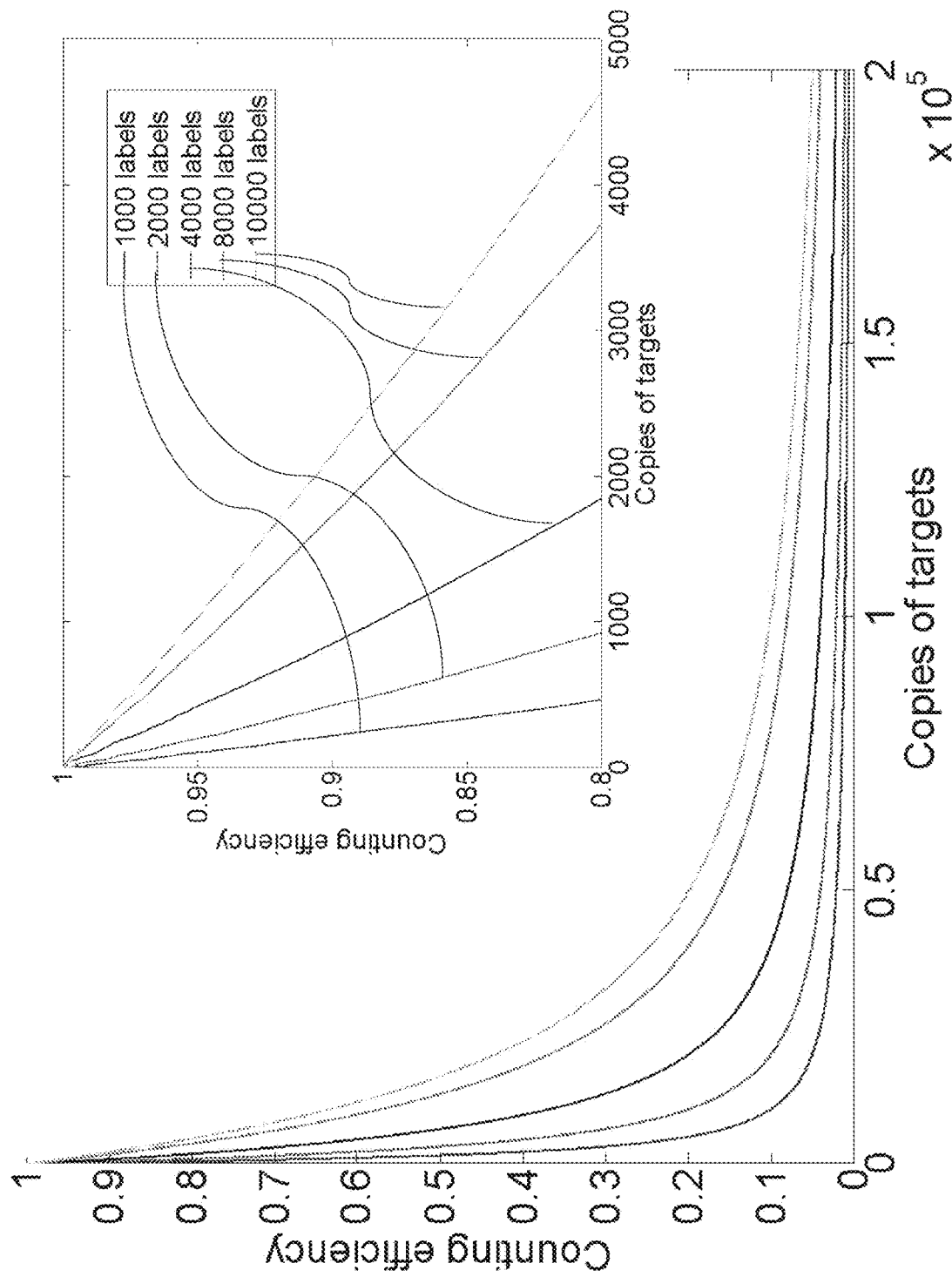
FIG. 20 shows a plot of counting efficiency versus copies of target as the number of labels varies. The inset is a magnification of the upper left portion of the graph.

FIG. 20 shows a graph of counting efficiency on Y axis and copies of target on X axis. The different lines represent different numbers of labels being used, from 1000 to 10,000. The inset graph is a blow up of the upper left hand region of the larger graph and shows how counting efficiency changes with the number of labels. Fewer labels results in a more rapid decrease in counting efficiency as the number of targets increases.

FIG. 21 is a plot of labels observed per target as the copies of targets increases and the number of label types increases.

Figure 5:
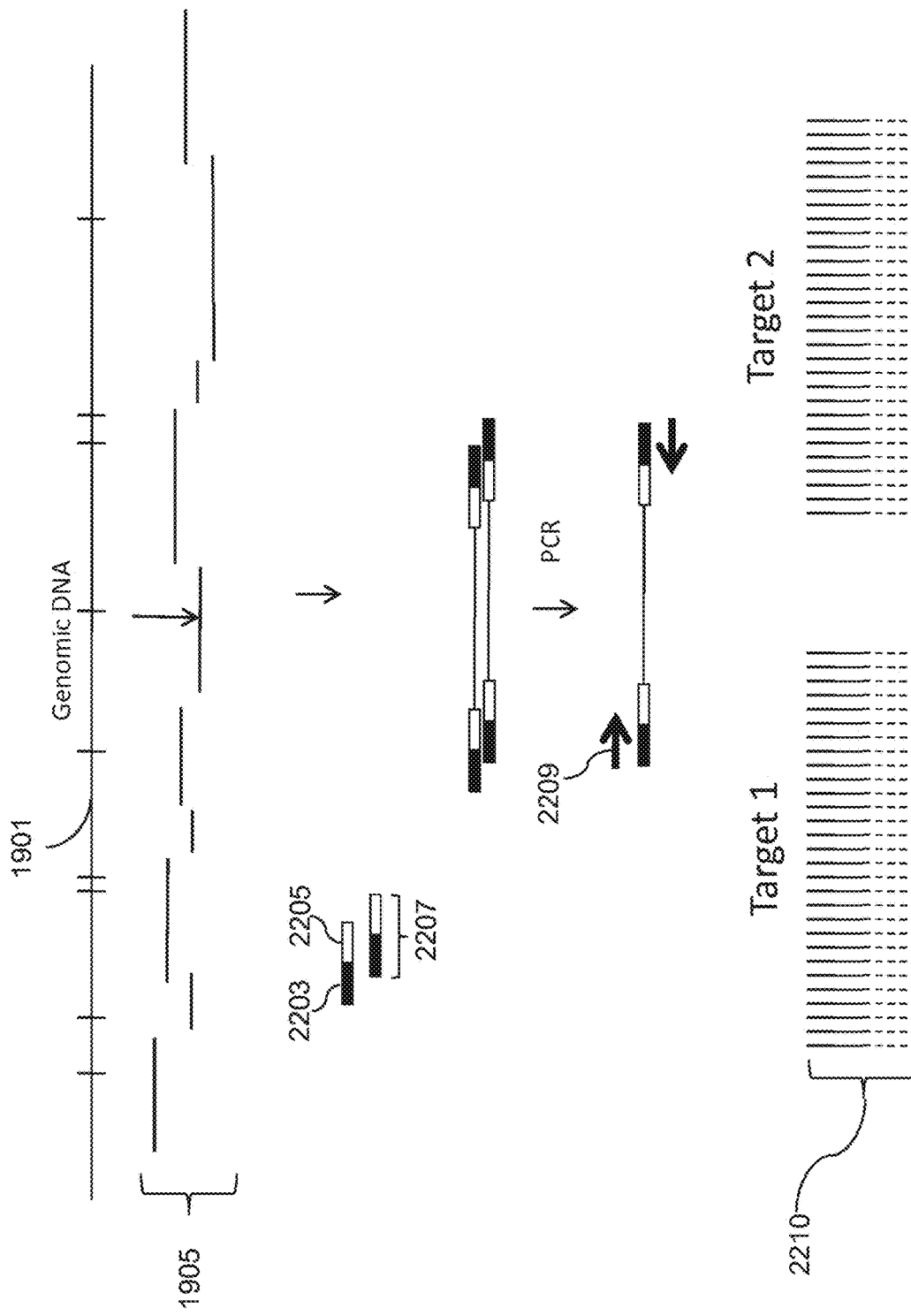
FIG. 5 shows a schematic of a method for target preparation.

In another embodiment, illustrated schematically in FIG. 5, genomic DNA 1901 is fragmented with a restriction enzyme, for example, BamHI, which generates a single stranded overhang for sticky ended ligation. The fragments 1905 are ligated to adaptors 2207 that include a label 2205 and a universal priming site 2203. Different adaptors vary in the label portion 2205 but have a common priming site 2203. The label is 3' of the universal priming site so that it is between the fragment and the universal priming site. The adaptor ligated fragments are amplified by PCR using primer 2209. The PCR product can be fragmented, labeled with a detectable label and hybridized to an array. The resulting strands are detected by hybridization to an array having target-label probes 2210 and includes different features for each target-label combination. The array has a different feature for each target-label-tag combination. The PCR amplicons may be fragmented prior to array hybridization. Preferably the fragments are labeled, for example, by TdT incorporation of a nucleotide that can be detected, such as a biotin containing nucleotide.

The probes of the array are complementary to the junction between the label and the restriction fragment. The sequences at the ends of the individual strands of the restriction fragments are predicted based on in silico digestion of the human genome. Also, fragments are targeted that are within the size range that is known to amplify efficiently by adaptor ligation PCR, for example, 200 bases to 2 kb. The adaptor 2201 had two segments, a constant priming region 2203 and a variable label region 2205. Together 2203 and 2205 form the label adaptor 2207. The primer 2209 has the same sequence 5' to 3' as the 2203. The schematic is drawn showing only one strand, but one of skill in the art would understand that in a preferred embodiment the genomic DNA is double stranded and the restriction fragments have two strands, which may be referred to as a top strand and a bottom strand. The convention is that the top strand is drawn 5' to 3' left to right and the bottom strand is the complement of the top strand and is drawn 3' to 5' left to right. Adaptors are preferably double stranded for at least a portion of the adaptor, they may have single stranded overhangs, for example to have "sticky ends" that facilitate hybridization and ligation to the overhang resulting from restriction digestion. In a preferred aspect, the same adaptor can be ligated to the two ends of a strand of a restriction fragment and may be ligated to one or both strands. The adaptor may be ligated to the ends of the top strand in opposite orientations as shown in FIG. 22, so that the label is internal to the priming site at both ends. The adaptor may have a top and a bottom strand and the top strand may be ligated to the top strand of the fragment and the bottom strand ligated to the bottom strand of the fragment. The top and bottom strands of the adaptor may be complementary over the entire length, but often have single stranded regions at one end to facilitate sticky ended ligation to an overhang created by a restriction enzyme.

To test this method several adaptors were generated. The test adaptor has PCR002 (SEQ ID No. 1969) as top or sense strand and BamAdaAS (SEQ ID No. 1970) as bottom or antisense strand.

```
PCR002
5' ATTATGAGCACGACAGACGCCTGATCT (1969)

BamAdaAS
3' AATACTCGTGCTGTCTGCGGACTAGACTAG 5'P (1970)
```

The single stranded region on the right is the BamHI single stranded overhang. Te adaptor also has a half Bgl II site. The "full length-label" adaptor has SEQ ID No. 1972 as top or sense strand and SEQ ID No. 1973 as bottom or antisense strand.

```
Sense
5' ATTATGAGCACGACAGACGCCTGATCTNNNNNNNNNNNNNNNT

AntiSense
3'AATACTCGTGCTGTCTGCGGACTAGANNNNNNNNNNNNNNNNACTAG
```

A 5' phosphate may be added to one or both strands of the adaptor using, for example, T4 polynucleotide kinase. In some aspects a truncated adaptor may be used. An example of such an adaptor is shown in FIG. 7, the top or sense strand is SEQ ID No. 1974 and the bottom or antisense strand is SEQ ID No. 1975. The portion of the sequence that has a line through it for both SEQ ID NOs. 1974 and 1975 indicates bases missing as compared to SEQ ID NOs. 1972 and 1973 respectively. The N's in SEQ ID NOs. 1972-1975 indicate a variable sequence in the adaptor that is different for each different label. For example, if there are 1,920 different labels to be used then the N14 represents the 1,920 different labels.

In some aspects it is preferable to use shorter oligos. The full length adaptor in includes 87 bases. The truncated adaptor has 57 bases. Since 2 different oligos must be synthesized for each different label adaptor (e.g. 1,920 labels requires 3,840 different oligos) shorter adaptors are more economical. The separate oligos are preferably annealed together prior to being combined into a pool for ligation to fragments. The primer may be, for example, SEQ ID NO. 1969 or the 5' 17 bases of SEQ ID No. 1974.

Figure 24:
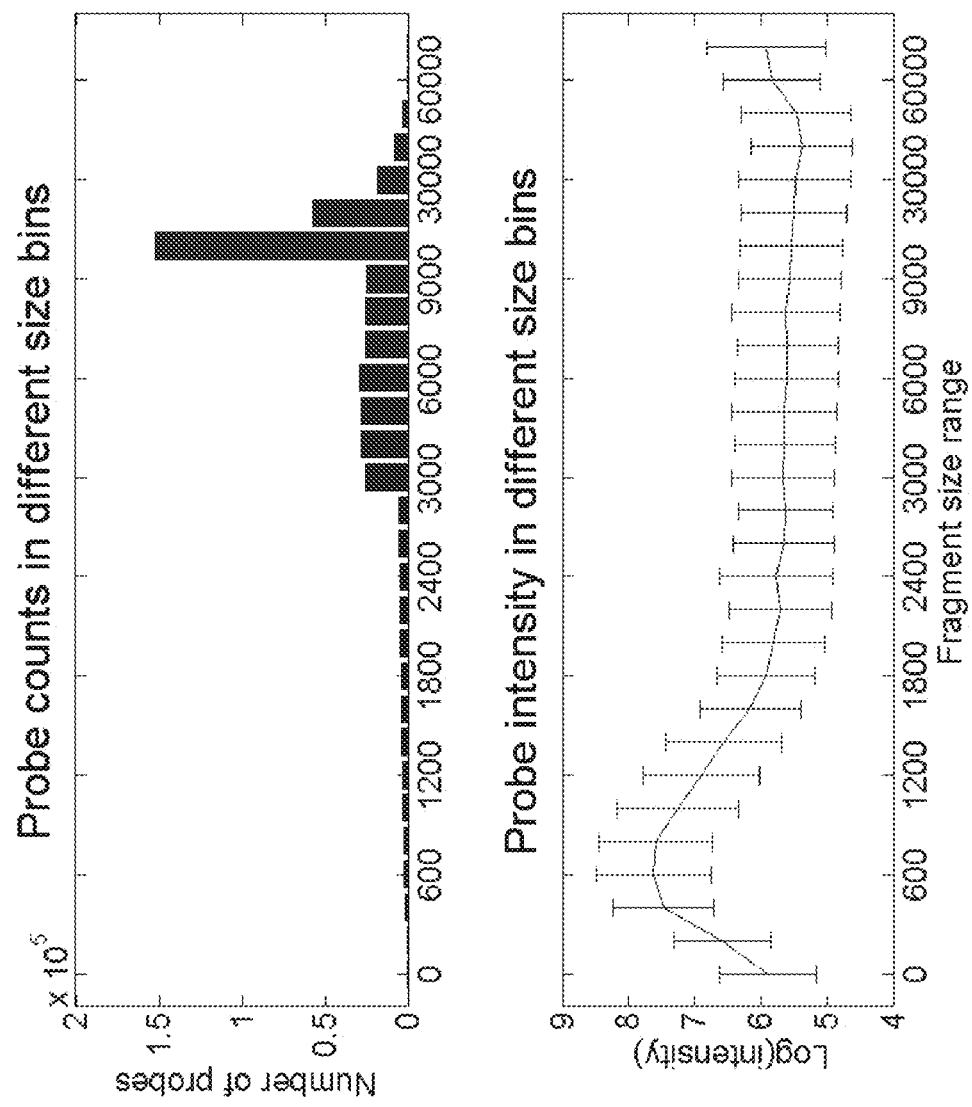
FIG. 24 shows plots showing fragment size distribution and mean raw intensity on chr22 tiling probes on the "CNVtype" array.

FIG. 24 shows the results of a control experiment where the test adaptor was ligated to fragmented genomic DNA and analyzed on an array having genomic probes. The DNA was subjected to fragmentation with a BamHI, the test adaptor was ligated to the ends and SEQ ID No. 1969 was used as a primer for PCR amplification. The PCR products were fragmented and end labeled using TdT and hybridized to a CNVtype and HG49 arrays. The upper plot is the number of probes (number of different features where each feature corresponds to a different probe sequence) complementary to restriction fragments in the different size bins shown on the X-axis. The sizes and sequences of restriction fragments from a selected genome can be predicted and binned according to size. The probes of the tiling array (probes essentially all non-redundant sequences in the genome) can be assigned to the restriction fragment to which the probe is complementary. Longer fragments will have larger numbers of probes that are complementary to that fragment, simply because the fragment is longer. Restriction fragment size is distributed based on the frequency of the occurrence of the recognition site. Note that the X axis does not increase linearly. While there are more probes that are complementary to fragments in the bins of size greater than 3000, particularly in the bins between 9000 and 30,000, but the intensity in those size bins is less than the intensity of the bins that are about 400 to about 1800. The larger fragments, greater than 9000 bases, for example, do not amplify efficiently with PCR, resulting in lower representation of those large fragments in the hybridization.

In another example, a truncated label adaptor was used (SEQ ID Nos. 1974 and 1975). The adaptor ligated fragments were extended to fill in the ends with polymerase prior to PCR. Hybridization was done in duplicate to either the CNV-type array or HG49 design C. Fragmented DNA and non-fragmented DNA were plotted. The intensity of the DNA that was not fragmented prior to hybridization is less than the intensity of the fragmented DNA. The peak of the intensity for both plots is at a fragment size of about 900 base pairs.

FIG. 11 shows a theoretical modeling of the number of counters predicted to be observed at least once 3201, exactly once 3202 or exactly twice 3203. A non-depleting reservoir of 960 diverse labels was considered. Equation (1) was used to calculate the at least once curve, equation (2) the exactly once curve and equation (3) the exactly twice curve. The error bars indicate one standard deviation from the corresponding mean value.

$$E[k] = m\left[1 - \left(1 - \frac{1}{m}\right)^n\right] \quad (1)$$

$$\mathrm{Var}[k] = m\left[1 - \left(1 - \frac{1}{m}\right)^n\right]\left(1 - \frac{1}{m}\right)^n + m(m-1)\left[\left(1 - \frac{2}{m}\right)^n - \left(1 - \frac{1}{m}\right)^{2n}\right] \quad (2)$$

FIG. 12 shows counting results for DNA copy number titrations using microarray hybridization in (A) or DNA sequencing in (B). Dilutions (3.62 ng, 1.45 ng, 0.36 ng and 0.036 ng) of a DNA sample isolated from cultured lymphoblasts of a Trisomy 21 male individual were processed for microarray hybridization (left) and DNA sequencing (right). Three chromosome targets were tested and observed numbers of counters (Y-axis) are shown (curve 1201). The number of target molecules for each sample (X-axis) was determined from the amount of DNA used, assuming a single cell corresponds to 10 pg. For comparison, the theoretical counter usage rates from the stochastic model equation are also plotted 1202. Numerical values are provided in Table 4.

BamHI cuts the human genome into an estimated 360,679 fragments with a size distribution of 6 bp to 30,020,000 bp. The median size is 5142 bp and the mean is 8320 bp. There are 79,517 fragments in the size range of 150 bp to 2 kb. For testing it may be desirable to choose fragments that meet selected criteria, for example, within a selected size range, select fragments that have more than 1 probe on the HG49m array, exclude fragments that are in known CNV regions, or exclude fragments having a SNP in the first or last 20-30 bases.

Figure 26:
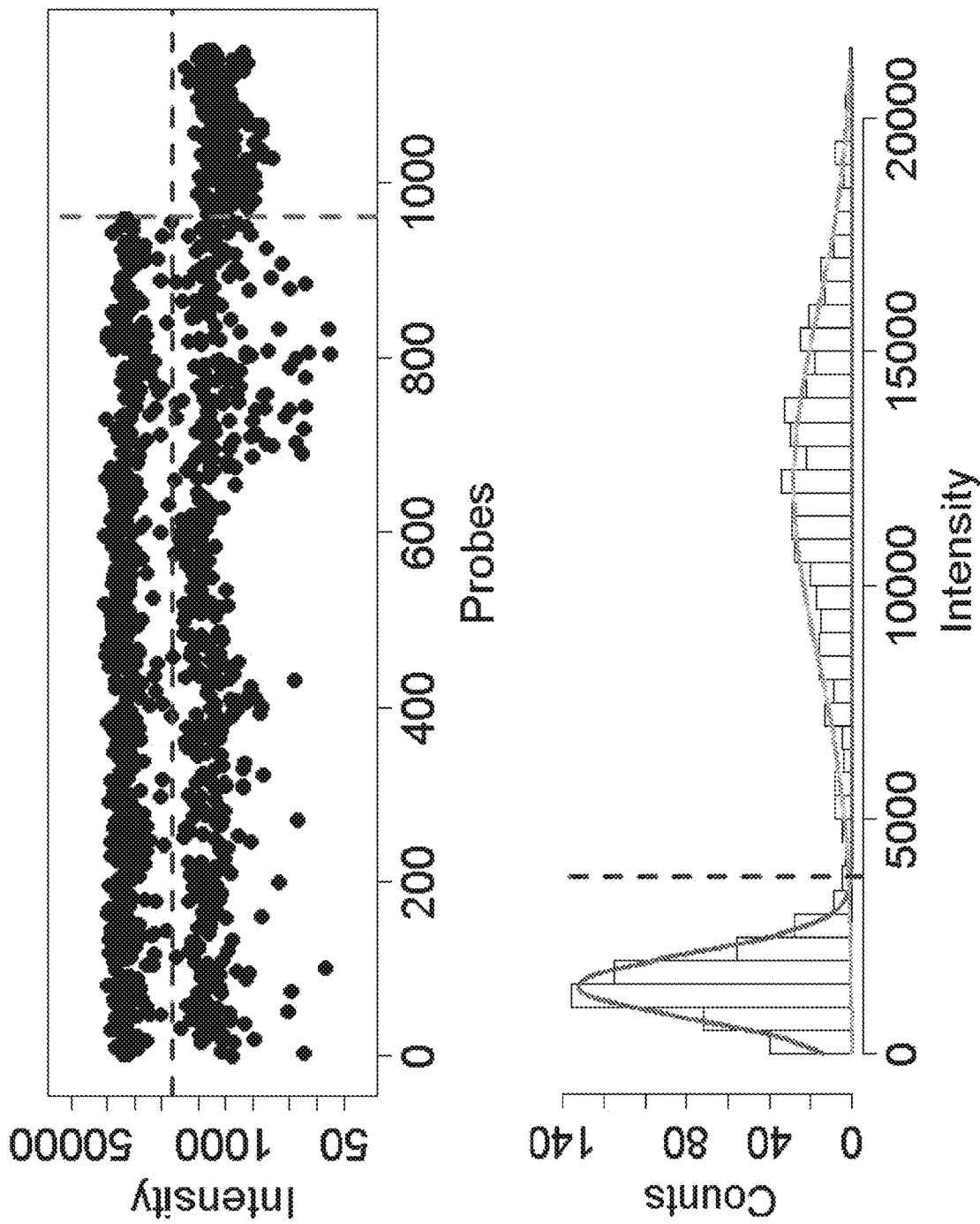
FIG. 26 shows intensities of 1,152 array probes associated with a single gene target on chromosome 4 in the upper panel and a histogram of the intensity data corresponding to 960 labels in the lower panel.

The upper panel of FIG. 26 shows the intensities of 1,152 array probes associated with one gene target on chromosome 4, chr4_01s. The data are from the array with 5 ng DNA, i.e., 1000 copies of the tested gene target. The 1,152 probes shown share the same genomic sequence portion, but have different label sequences. Each black dot represents one label sequence. The left 960 dots (on the left side of the red vertical line) correspond to specific labels (i.e., labels used in ligation reaction), and the right 192 dots correspond to non-specific labels (i.e., labels not used in ligation reaction). The probe intensities were plotted in natural log scale on the y-axis. The blue horizontal line is the threshold determined by analysis algorithm (see Materials and Methods), which has a value of 3,800.

The array design for the experiment represented in FIG. 26 is as follows. For each gene target assayed, the array probe consists of all possible combinations of the 960 label sequence and either of the two BamHI genomic fragment ends. An additional 192 label sequences that were not included in the adaptor pool were also tiled to serve as non-specific controls. This tiling strategy enables consistency check on the number of labels used at the paired ends, since each target fragment is ligated to two independent labels (one on either end), and for the same target fragment, the counts on the left and right side should be very similar.

The lower panel shows the histogram of the intensity data corresponding to 960 specific labels. Also shown in the figure are the 2 fitted normal distributions, designated by red and green curves, respectively. The fitted distributions have the mean and standard deviation of 1447±680 and 12186±3580, respectively. The blue vertical line is the threshold, which has the same value as the blue horizontal line shown in the upper panel. Based on such threshold, 501 probes (i.e., labels) were counted as "used".

Figure 27:
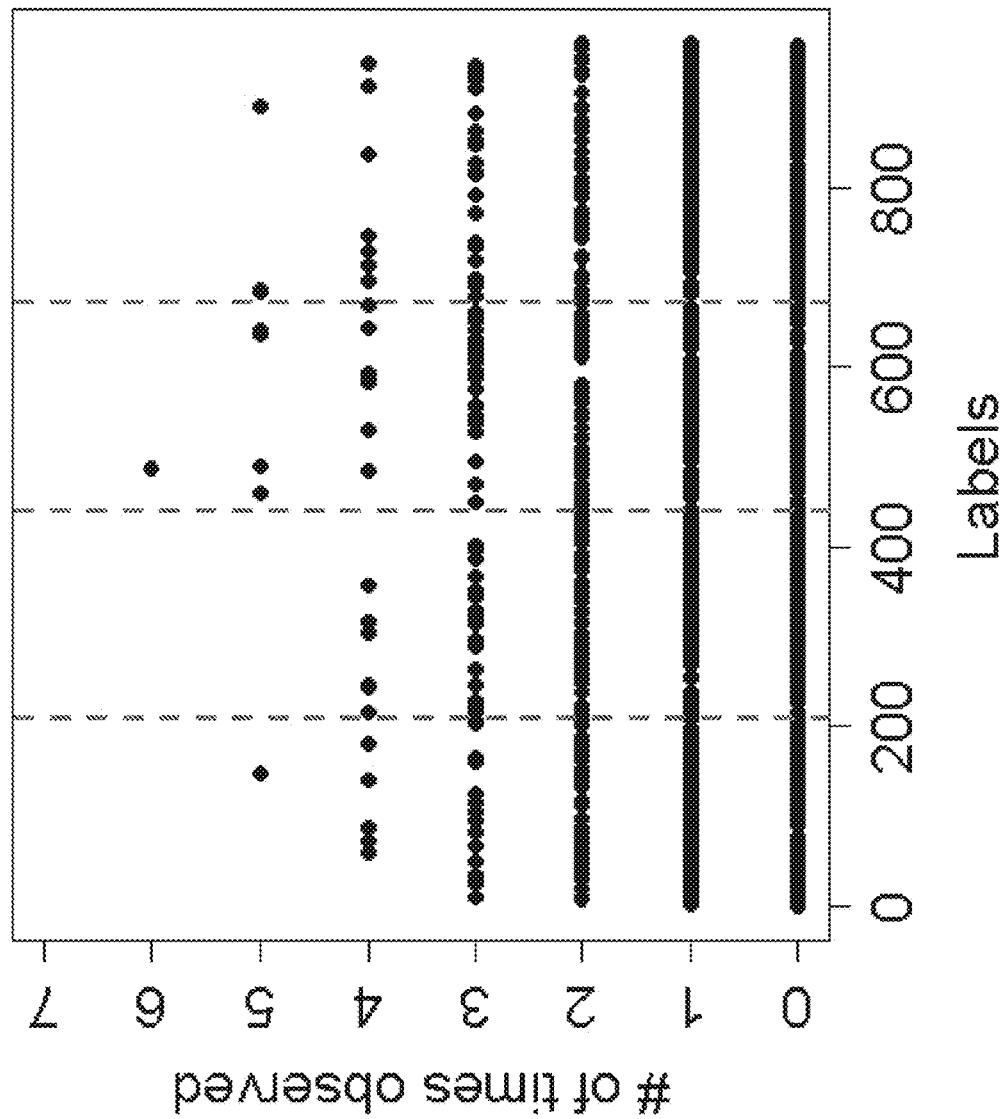
FIG. 27 shows a plot of the number of times each of the 960 labels was observed in ligations with low DNA target amounts.

FIG. 27 shows the number of times observed for each of the 960 specific labels. Empirically, we did not observe 349 labels in any of the 20 cases. By model, we would expect to observe 643.05±9.96 labels at least once, which means we expect not to observe 307-327 labels. This result shown was obtained by grouping labels used in independent ligation reactions together. To more accurately estimate the frequency of usage of labels, only data from experiments with low concentrations (0.05 ng and 0.5 ng of DNA ligation amount) were considered. Under each concentration, 5 different gene targets independently ligated to labels at both ends. Therefore, a total of 20 independent reactions (2 concentrations×5 gene targets×2 ends) were grouped together. Of these reactions, 1,064 labels were observed; some were observed more often than the others, the frequency of usage of labels ranges from 0 to 6.

Figure 28:
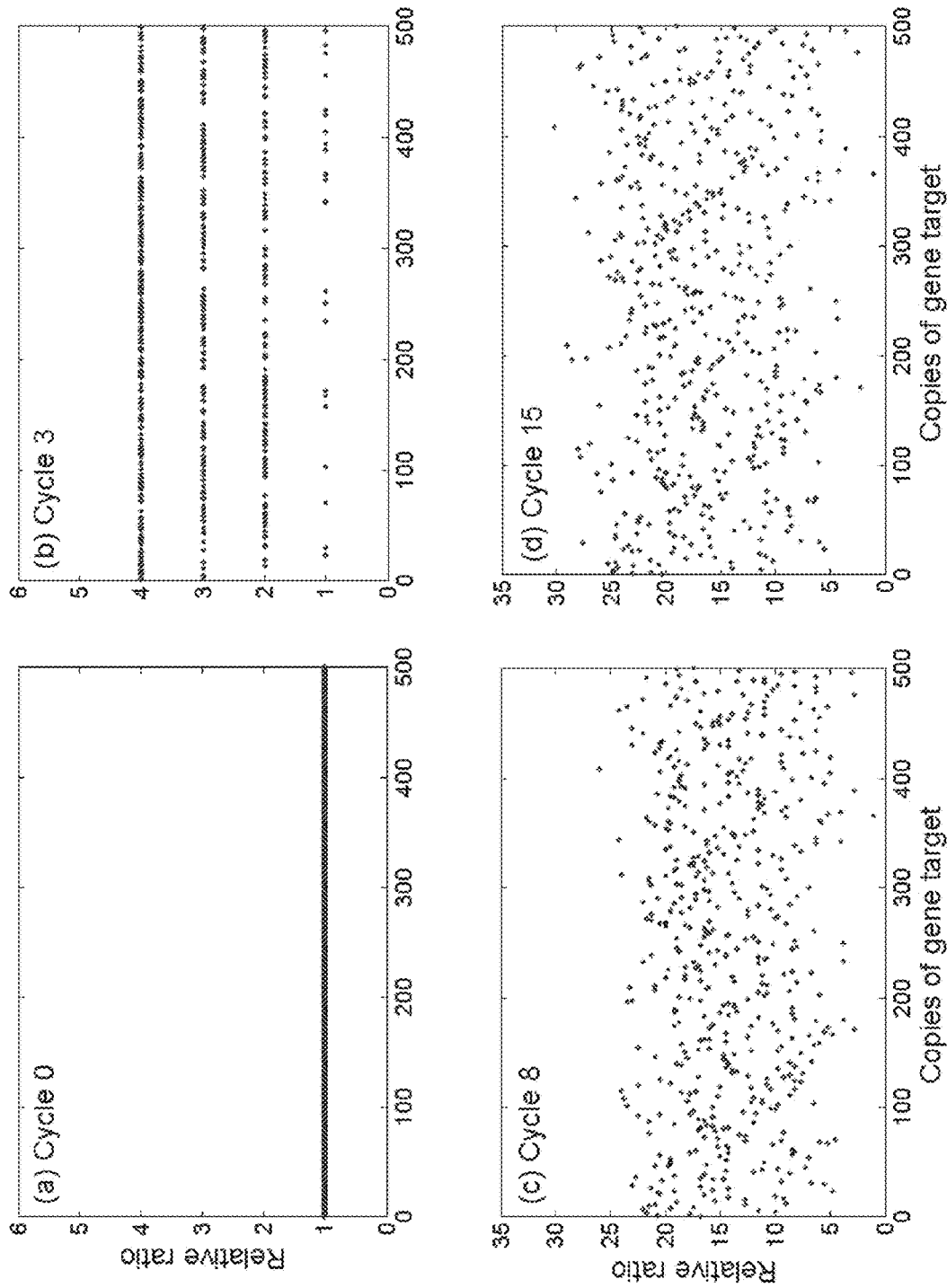
FIG. 28 shows an example of a replication process on a collection of 390 uniquely labeled target molecules resulting from 960 diverse labels independently marked with 500 copies of a target molecule.

FIG. 28 shows one example of the replication process of 500 copies of a gene target. In each subplot, copies of target molecules were plotted in the same order. The y-axis is the relative ratio of the number of amplified molecules over the minimal number of amplified molecules in each PCR cycle. Before PCR, all copies are of equal amount, i.e., each copy has one molecule at cycle 0 (subplot (a)). As the PCR process goes on, we start to see differences in the number of amplified molecules corresponding to different copies of target molecules. For example, in cycle 3 (subplot (b)), the ratio between most and least abundant of amplified molecules is 4. Such ratio becomes larger as the number of PCR cycle increases. In cycle 8 and 15, the ratio becomes 26 and 30, in cycles 8 and 15 respectively (see subplots (c) and (d)). This suggests that the differential usage of labels may be observed before PCR is started. Such difference in the amount of molecules associated with different labels will carry on as PCR process goes on.

PCR simulation. We defined n copies of a gene fragment T, each ligated to a single counter randomly selected from an infinite pool of m unique counters to generate a collection of k resulting counter-ligated gene target molecules $T^* = \{tl_i, \ldots, i=1,2, \ldots, k\}$. We assumed that each counter-ligated gene target molecule $tl_i$ replicates randomly and independently of other target molecules; and that the replication probability p (i.e., amplification efficiency) of different molecules, $tl_i$, remains constant throughout the PCR process. For each $tl_i$, we denote the number of molecules at PCR cycle c as $N^c_i$. When c=0, $N^0_i$ is the initial number of $tl_i$. The PCR process at cycle c+1 can be modeled as a series of $N^c_i$ independent trials that determine the replicability of each of the $N^c_i$ molecules with replication probability p. Let $\Delta N^c_i$ represent the number of molecules replicated at cycle c+1, then the number of molecule $tl_i$ after cycle c+1 is $N^{c+1}_i = N^c_i + \Delta N^c_i$, where the probability of $\Delta N^c_i$ is $$p(\Delta N^c_i | N^c_i) = \binom{N^c_i}{\Delta N^c_i} p^{\Delta N^c_i} (1-p)^{N^c_i - \Delta N^c_i}. \quad (2)$$

We determined the relative abundance of different counter-ligated gene target molecules $tl_i$, upon completion of the simulated PCR run for n=500, 50, or 5, and p=0.8, 0.7 or 0.6 (Table 5). In each case, we performed 1,000 independent runs to simulate 30 cycles of adaptor PCR, followed by 30 cycles of gene-specific PCR.

TABLE 5

Shows summary statistics drawn from 100 independent simulation runs modeling PCR, ligation at each end of targets is considered.

| | Initial copy number | | | | | |
|---|---|---|---|---|---|---|
| | N = 5 | | N = 50 | | N = 500 | |
| | | | Side | | | |
| | Left | Right | Left | Right | Left | Right |
| #of labels observed | 5 | 5 | 48.61 0.99 | 48.64 1.09 | 388.91 6.85 | 389.27 7.18 |
| Max | (1.43 0.19) *10^11 | (1.43 0.19) *10^11 | (2.18 0.49) *10^10 | (2.13 0.47) *10^10 | (4.52 0.59) *10^9 | (4.44 0.55) *10^9 |
| Min | (5.73 2.27) *10^10 | (5.73 2.27) *10^10 | (2.35 1.06) *10^9 | (2.35 1.06) *10^9 | (1.15 0.49) *10^8 | (1.23 0.49) *10^8 |
| Ratio btw max & min | 3.13 2.44 | 3.13 2.44 | 14.10 11.41 | 13.87 13.42 | 43.42 25.66 | 44.92 30.04 |
| Mean | (1.00 0.16) *10^11 | (1.00 0.16) *10^11 | (1.03 0.06) *10^10 | (1.03 0.06) *10^10 | (1.27 0.03) *10^9 | (1.27 0.03) *10^9 |
| Standard deviation | (3.44 1.02) *10^10 | (3.44 1.02) *10^10 | (3.98 0.52) *10^9 | (3.94 0.54) *10^9 | (6.75 0.41) *10^8 | (6.69 0.40) *10^8 |
| Coef. of variation | 0.36 0.13 | 0.36 0.13 | 0.39 0.05 | 0.38 0.05 | 0.53 0.03 | 0.53 0.03 |

Focusing on the experiments with concentrations of 0.5 and 0.05 ng, ($3^{rd}$ and $4^{th}$ in each group of 5), which provide the most accurate count of labels, there are 20 different opportunities for a given label to be observed (2 concentrations×5 amplicons $\chi$ 2 sides (left or right)). We observed 1,064 labels over the 20 opportunities.

Figure 25:
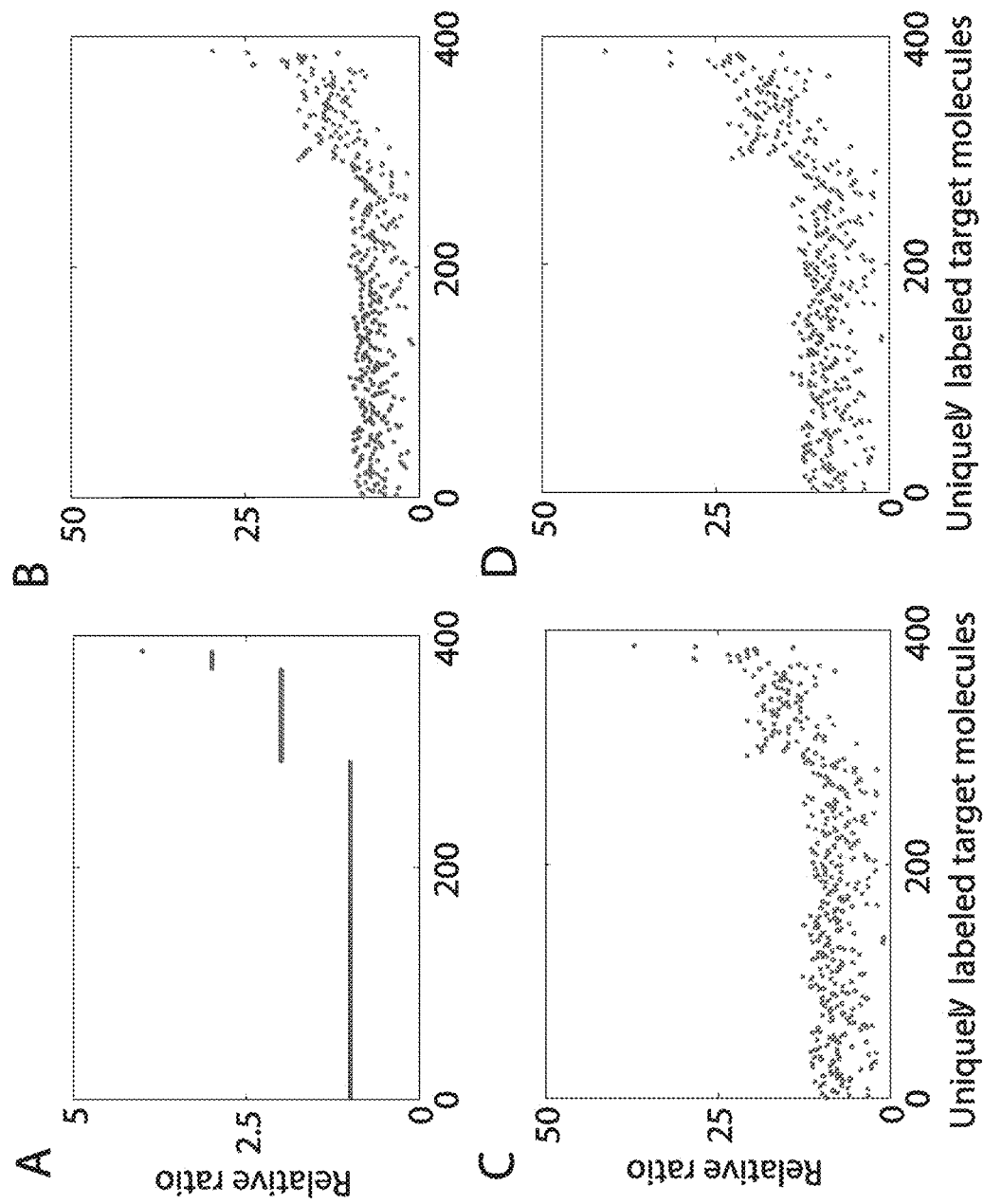
FIG. 25 shows a simulated PCR run showing the replication outcome for 500 molecules of a target fragment ligated to a library of 960 label counters.

To observe the distortion of the relative abundance of DNA molecules in the reaction resulting from the PCR process, dispersion in the quantitative distribution of PCR amplified DNA molecules was analyzed. A model of the PCR process was generated to understand the dispersion in the distribution of amplified molecules (FIG. 25, Table 6). A series of 1,000 independent simulation runs were performed to simulate the replication of uniquely labeled target molecules through PCR processes. For each run, we measured the distribution of the final amount of PCR products and quantified the dispersion of distribution using two measures: ratio of the maximal to the minimal amount, and coefficient of variation of final PCR products. This demonstrates that the degree of dispersion increases with the incidence of replicate use of identical counters, which may be in-part responsible for the deviation observed when assaying high target copy numbers. Table 6 lists the ratio and CV for distributions corresponding to different concentrations and replication probabilities (one sided ligation considered).

TABLE 6

|  | replication probability | n = 5 | n = 50 | n = 500 |
|---|---|---|---|---|
| Ratio of max to min amount of PCR amplified product | p = 0.6 | 5.69 ± 4.95 | 26.16 ± 23.78 | 124.18 ± 88.04 |
|  | p = 0.7 | 4.59 ± 8.03 | 16.22 ± 15.53 | 71.55 ± 55.13 |
|  | p = 0.8 | 2.82 ± 1.51 | 11.54 ± 9.53 | 42.24 ± 27.49 |
| Coefficient of Variation (CV) | p = 0.6 | 0.48 ± 0.16 | 0.51 ± 0.06 | 0.62 ± 0.03 |
|  | p = 0.7 | 0.41 ± 0.14 | 0.44 ± 0.05 | 0.57 ± 0.02 |
|  | p = 0.8 | 0.34 ± 0.12 | 0.36 ± 0.05 | 0.52 0.02 |

Example 1 of a method for selecting a collection of labels starting with all possible 14 mers (414 or ~268 million possible labels). Step 1: clustering based on the last 7 bases: all sequences with the same last 7 bases are grouped together; within each cluster, randomly pick one sequence, this gives us 11,025 sequences, denoted by set A. Step 2: clustering based on the first 7 bases: all sequences with the same first 7 bases are grouped together; within each cluster, randomly pick one sequence, this gives us 13,377 sequences, denoted by set B. Step 3: get the union set of set A and B, the combined set has 24,073 sequences. Then do clustering based on the middle 6 bases, randomly pick one sequence out of every cluster, this gives us 3,084 sequences, denoted by set C. Step 4: calculate the all-against-all alignment score of set C, which gives us a 3,084×3,084 self-similarity score matrix, denoted by S. Step 5: filter based on the score matrix. If an element of the score matrix S(i,j) has a high value, that means, the corresponding sequences i and j are very similar to each other. Starting from the elements with top self-similarity score, randomly pick one and discard the other; repeat this process until the number of retained sequences<2000. Until this step, 1,927 sequences were retained.

For the retained 1,927 sequences, an all-against-all complement score was calculated for each. This gave a 1,927×1,927 cross complement score matrix. A step similar to step 5 was performed, to avoid labels with maximal cross-complement with other labels. Starting from the pairs with top cross-complement score, one was randomly pick and the other discarded. This process was repeated until the number of retained sequences was 1920. Next the 1920 labels were split into 2 sets, with one set (denoted by set A) consisting of sequences that are maximum different from one-another; and the other set (denoted by set B) consisting of the remaining sequences. The procedure used to split sequences was as follows. Starting from the original 1920 by 1920 similarity score matrix, for each sequence, (1) sum up all its similarity scores with the rest of the sequences in the pool, that is, for each sequence, calculate a total similarity score. (2) Sort the total similarity scores of all sequences and select the sequence with the lowest total score, and move it to set A. (3) Remove the row and column corresponding to the selected sequence, i.e., both the number of rows and columns in the similarity score matrix are reduced by 1. Repeat steps 1-3, until the number of rows and columns in the similarity score matrix reaches 960 or half of the original. The selected sequences belong to set A and the remaining sequences belong to set B.

In another embodiment a collection of labels is selected using the following steps. Starting with all possible 14 mers ($4^{14}$ or ~268 million possible labels) eliminate all that do not have 50% GC content. Eliminate those were each nucleotide does not occur at least twice. Eliminate those that have more than two G/C in tandem or more than three A/T in tandem. Eliminate those that contain a selected restriction site. That reduces the original set to ~33 million or 12.43% of the original set. From that set select those that have a Tm within the range of 38.5° C. to 39.5° C. This step results in a set of ~7 million or 2.73% of the original set. Remove those that have regions of self-complementarity. The resulting set in this example was now 521,291. A hierarchical clustering was performed to identify a set that has maximum sequence difference between one-another. The resulting set contained 1,927 labels. Labels were removed if the sequence had a tendency to bind to other labels in the set. This reduced the set to 1,920 labels. A final set of 960 labels was selected from the 1,920 as being maximally different for the "specific" labels and 192 additional counters to tile on the array as "non-specific" controls.

Selection of Targets and design of test array. Regions selected to assay as targets included Chr X, Chr Y, Chr 4 as a reference and Chr 21 for Trisomy. Locations on the chromosomes for assaying were selected to avoid centromeres and telomeres. Fragments were selected based on Bam HI fragments of between about 400 and 600 base pairs. Fragment intensity was checked using HG49 array hybridization. The first and the last 26 nucleotides of the fragments (from and including the Bam HI site) were tiled. Repeats were avoided and GC % was optimized.

The array format was 100/25. Feature size is 5um. There are 436×436 features or 190,096 features. Synthesis was NNPOC, 43 mer probes, 5' up, no phosphate. The chip name is STCL-test2. The gridding probe used was the same as the HG49. No QC probes were included.

Aside from reducing whole chromosomes into 360,679 smaller molecular weight DNA pieces more suitable for ligation reactions, restriction digestion also serves to reduce the overall sequence complexity of the sample, as only an estimated 79,517 fragments reside in the 150 bp-2 kb size range that is effectively amplified by PCR. To detect and quantify counters that have been selected by the target molecules, the labeled genomic target fragments may be circularized and PCR amplified to prepare for analysis, for example, using microarray hybridization or DNA sequencing. A representative BamHI target fragment was sampled for each of the three test chromosomes. Simultaneous measurements of all three chromosomes serve as an internal control independent of dilution or other systematic errors. A suitable DNA array detector capable of distinguishing the set of counters bound to copies of the target molecules was constructed using photolithography (S. P. Fodor et al., *Science* 251, 767 (Feb. 15, 1991).). Each array element for a target to be evaluated consists of a target complementary sequence adjacent to one of the complements to the 960 counter sequences (FIGS. 1 and 2A). For increased specificity, a ligation-readout was performed on the microarray after hybridization to avoid false positive detection of the cross-hybridization of identical targets with different counters. As a means of validation through a secondary measure, samples hybridized to microarrays were subsequently sampled by DNA sequencing (FIGS. 10 and 29).

Figure 16:
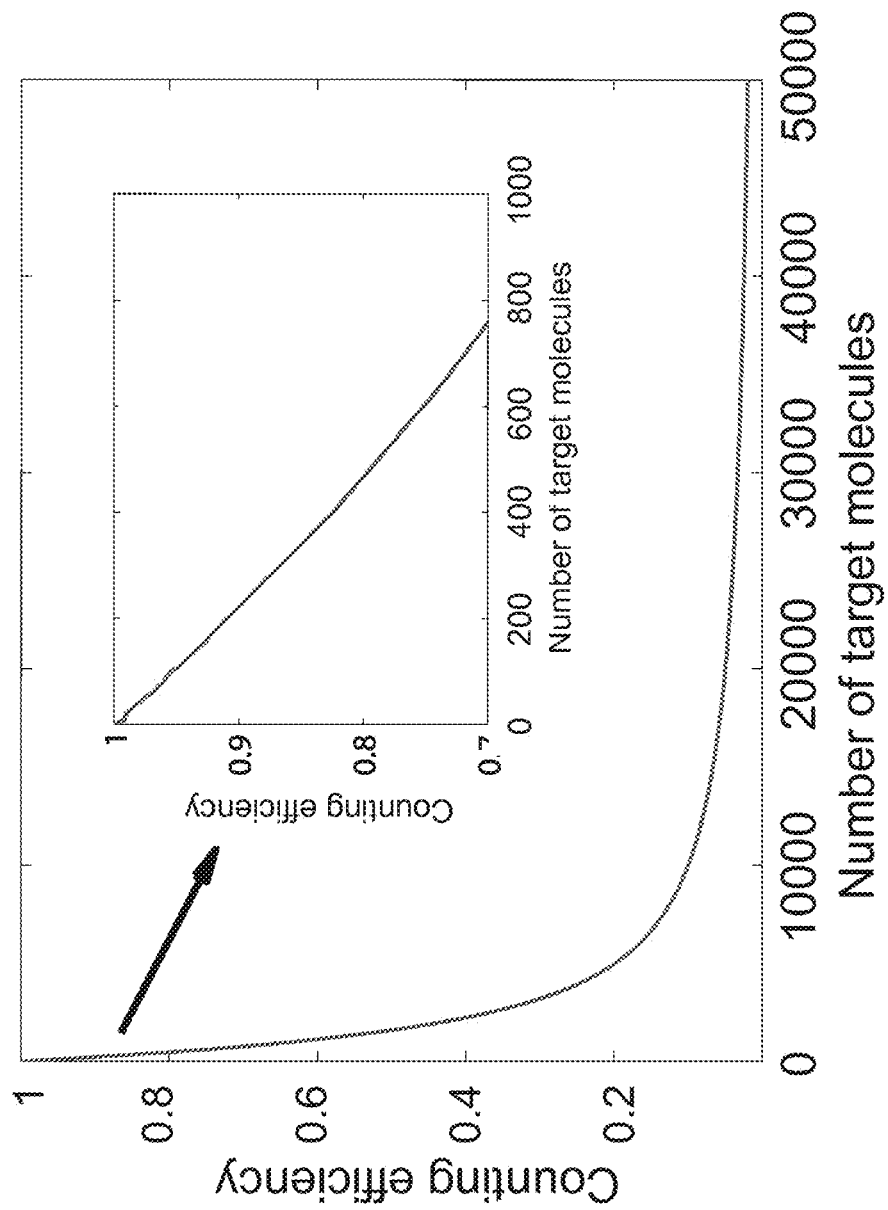
FIG. 16 shows a plot of number of target molecules (x-axis) compared to counting efficiency (y-axis).
Figure 17:
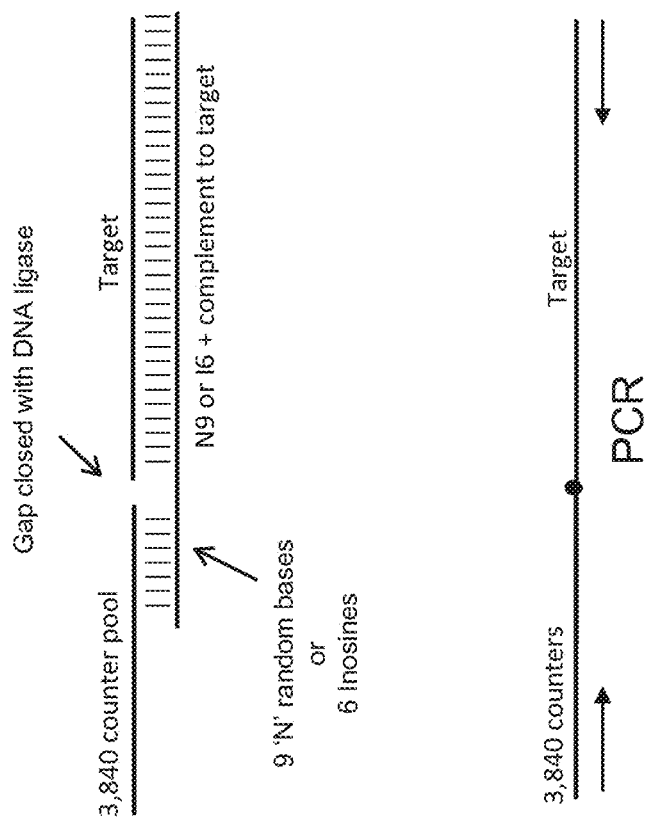
FIG. 17 shows a schematic of a method for attaching labels to targets using a splint having a variable region.

An equation to model the stochastic labeling of target molecules with a small library of 960 counters, and validate our equation model with numerical simulations is disclosed. In the model, the diversity of counters selected by, and ligated to target molecules in the reaction solution (simplified as 'used') is dictated by the number of copies of molecules present for each target fragment in the reaction (FIG. 12). Under conditions where the size of the counter library is much greater than the number of copies of a given target molecule, the counting efficiency is high, and counting the number of counters used is equivalent to counting the number of copies of the original target molecules (FIG. 16). When the number of target copies approaches and exceeds the number of different counters in the reaction, any counter in the library is more likely to be used multiple times (FIG. 15). The number of counters used at least once is an important measure because it serves as the basis for drawing yes/no conclusions in our digital readout on microarrays. Under stochastic labeling conditions, we expect that the absolute quantity of single DNA molecules can be accurately determined by proxy counts of labeling events. Indeed, microarray experiments demonstrate a high degree of correlation between the number of copies of target molecules added to the reaction and the number of counters used, as detected on microarrays (FIG. 12). In particular, counter usage precisely profiles the number of target molecules under conditions of high counting efficiency. Subtle deviations from the model may represent minor dilution errors in the preparation of the sample. However, within that sample dilution, the relative counter ratios of the three internally built-in markers are highly accurate (FIG. 13). FIG. 13 shows comparison of relative copy ratios of the three gene targets tested: ChrX, Chr4 and Chr21 representing genetic material of one, two and three copies per cell. Different dilutions (5 ng, 2 ng, 0.5 ng and 0.05 ng) of a DNA sample isolated from cultured lymphoblasts of a Trisomy 21 male individual were processed for microarray hybridization and DNA sequencing. The calculated number of target molecules (see, Table 4, column 9) was inferred from the number of counters detected on microarrays (A), and was also calculated for the SOLID sequencing data (B). For each sample dilution, the target copy number ratio of each gene target relative to ChrX is shown.

On the other hand, when target copies exceed ~100, detected labeling events appear to indicate fewer than actual molecules in solution (FIG. 12 inset in graph on left). This deviation was reproducible and consistently observed across multiple microarray experiments, and was also observed in the DNA sequencing experiments (FIG. 12 inset in graph on right). Under-counts of expected labeling events may originate from inadequate detection sensitivity of the microarray platform or from other systematic or indeterminate deficiencies in the sample preparation procedure. PCR, for example, is prone to amplification bias (T. Kanagawa, *J Biosci Bioeng* 96, 317 (2003) and M. F. Polz, C. M. Cavanaugh, *Appl Environ Microbiol* 64, 3724 (1998)), which could hinder the comprehensive detection of labeling events that may be genuinely stochastic.

To confirm the microarray results, a digital sequence counting of individual molecules in the DNA samples hybridized to microarrays was used as a means of validation, and to detect the presence of any false negatives that may have escaped microarray detection. Analysis of mapped sequence reads resulted in counts in agreement to the microarray observations. Furthermore, a second, independent sequencing run was repeated with similar findings (Table 3).

An additional feature of digital sequence counting is that unlike the microarray intensity data (FIGS. 22 and 23), which offers lower resolution into the measurement of the concentration dispersion of PCR amplified molecules, sequence counting clearly demonstrates significant variation in the representation of amplified targets (FIG. 29), This is consistent with the computed PCR model. Overall, detected counters on the microarray and sequencing experiments correlate well, but a small subset of counters appear to be unique to each process (Table 7). The observed number of labels in common between the microarray and the two sets of sequencing experiments are summarized in the table. The number of labels in each category is included. The categories are as follows: A+1+2 for labels detected in each of the 3 experiments, 1+2 for labels detected only in sequencing runs 1 and 2, 1+A for labels detected in sequencing run 1 and by array, and so on for the amounts of DNA shown in column 3.

TABLE 7

| | DNA sample | | A + 1 + 2 | 1 + 2 | 1 + A | 2 + A | 1 | 2 | A |
|---|---|---|---|---|---|---|---|---|---|
| Chr4 | Left side | 0.036 ng | 13 | 0 | 0 | 0 | 0 | 0 | 1 |
| | | 0.36 ng | 96 | 3 | 0 | 1 | 2 | 2 | 5 |
| | | 1.45 ng | 228 | 13 | 4 | 22 | 6 | 10 | 6 |
| | | 3.62 ng | 484 | 23 | 2 | 3 | 4 | 6 | 12 |
| | Right side | 0.036 ng | 14 | 0 | 0 | 0 | 0 | 0 | 0 |
| | | 0.36 ng | 100 | 1 | 0 | 0 | 2 | 2 | 7 |
| | | 1.45 ng | 249 | 25 | 2 | 0 | 15 | 33 | 5 |
| | | 3.62 ng | 511 | 22 | 2 | 1 | 9 | 23 | 11 |
| Chr21 | Left side | 0.036 ng | 18 | 0 | 2 | 0 | 0 | 0 | 0 |
| | | 0.36 ng | 150 | 0 | 2 | 4 | 0 | 7 | 4 |
| | | 1.45 ng | 324 | 17 | 8 | 1 | 32 | 16 | 2 |
| | | 3.62 ng | 637 | 14 | 10 | 0 | 17 | 14 | 4 |
| | Right side | 0.05 ng | 18 | 0 | 1 | 1 | 0 | 0 | 0 |
| | | 0.36 ng | 144 | 0 | 2 | 2 | 0 | 0 | 9 |
| | | 1.45 ng | 330 | 34 | 2 | 3 | 15 | 12 | 6 |
| | | 3.62 ng | 615 | 29 | 1 | 7 | 5 | 2 | 4 |
| ChrX | Left side | 0.036 ng | 11 | 0 | 0 | 0 | 0 | 0 | 0 |
| | | 0.36 ng | 42 | 0 | 0 | 0 | 1 | 3 | 8 |
| | | 1.45 ng | 137 | 3 | 1 | 5 | 8 | 5 | 5 |
| | | 3.62 ng | 274 | 12 | 0 | 2 | 4 | 12 | 5 |
| | Right side | 0.036 ng | 10 | 1 | 0 | 0 | 1 | 0 | 0 |
| | | 0.36 ng | 43 | 0 | 3 | 0 | 4 | 0 | 2 |
| | | 1.45 ng | 127 | 15 | 0 | 0 | 11 | 25 | 6 |
| | | 3.62 ng | 298 | 12 | 3 | 3 | 24 | 31 | 2 |

For the reverse scenario, high numbers of mapped sequence reads were always observed to correlate with high microarray intensities in these examples. No systematic or sequence correlations, or explanations were identified for the counters that are absent from any given sequencing experiment for which the microarray readout demonstrates a strong signal. While obviously underrepresented in some experiments, the same counters are sometimes present in high sequence counts in other experiments, suggesting that they are available for sequencing. PCR was used to resolve these isolated cases of disagreement and demonstrate these were false negatives in the sequencing experiments (Table 3). Despite their presence in the sequencing library, it is unclear why the counters were not observed or were underrepresented in the original sequencing run, and also in the subsequent replicate sequencing run.

Aside from the comparative analysis of absolute and relative counts of the numbers of target molecules and counter labels, additional ways to assess the stochasticity of the labeling process were evaluated. First, if the labeling process is random, the frequency of incorporation of identical counters in independent events across the paired left and right termini of target fragments should closely resemble outcomes from numerical simulation. Observed counts on microarrays do in fact match closely with numbers obtained from computer simulations (Table 4, columns 10-11). Second, if the target molecules are labeled randomly with an equal likelihood of incorporation for any member of the 960 counters in the library, we would expect the number of repeated observations of counters to follow a stochastic nature. For this analysis, we accumulated a total of 1,064 counter observations over several microarray experiments restricted to low target copy numbers. Exclusion of data from high copy targets was necessary to avoid undercounting labeling events from multiple incidences of identical counters attaching individually to numerous target copies. As a further and final demonstration of stochastic labeling, results show that the frequency of label usage follows a pattern consistent with outcomes from numerical simulation.

CONCLUSION

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby. All cited references, including patent and non-patent literature, are incorporated herein by reference in their entireties for all purposes and particularly to disclose and describe the methods or materials in connection with which the publications are cited.

SEQUENCE LISTING (1979 sequences)

SEQ ID NO: 1 - DNA, 875 bp, synthetic construct
  misc_feature 1..875: note = synthetic oligonucleotide
  source 1..875: mol_type = other DNA
gatccaccaatccatacatgagacggcccaatccagttagtccttatccaaactcttcacacacttcagatatctatggaagcaccagccctatgaacttctattccacctcatctcaagctgcaggttcatatttgaattcttctaatcccatgaacccttaccctgggcttttgaatcagaatacccaatatccatcatatcaatgcaatggaaacctatcagtggacaactgctccccatatctgggttcctattctccccagtctcagccgatggatctgtataggtatccaagccaagaccctctgtctaagctcagtctaccacccatccatacactttaccagccaaggtttggaaatagccagagttttacatctaaatacttaggttatggaaaccaaaatatgcagggagatggtttcagcagttgtaccattagaccaaatgtacatcatgtagggaaattgcctccttatcccactcatgagatggatggccacttcatgggagccacctctagattaccacccaatctgagcaatccaaacatggactataaaaatggtgaacatcattcaccttctcacataatccataactacagtgcagctccgggcatgttcaacagctctcttcatgccctgcatctccaaaacaaggagaatgacatgctttcccacacagctaatgggttatcaaagatgcttccagctcttaaccatgatagaactgcttgtgtccaaggaggcttacacaaattaagtgatgctaatggtcaggaaaagcagccattggcactagtccagggtgtggcttctggtgcagaggacaacgatgaggtctggtcagacagcgagcagagctttctg

SEQ ID NO: 2 - DNA, 934 bp, synthetic construct
  misc_feature 1..934: note = synthetic oligonucleotide
  source 1..934: mol_type = other DNA
gatccaggactgttttcatgctagtctggctcacagaacgctagcaggttgtactgaccttcaggacaagcgtaagtaagacctacgatgctcgtttgatcccaacagttatctcccctttctcagttcctgtcttctcccagagggtggcaggtagctggggaagagatgactgggagtggagaggtgccgctgaccattatggtggcagctactcattcagggtgctctcctcctaattctgctggagaacactattttgggacaatttgtcatcttggctggagggtcctttcctaaagtctagcactgatagaacacaaggacgtaagtgctgccttttaaccaggaaggcgaaggcaaacttttctttaaaggagagagttgcaggtaatccctggtgtttttttttttcaatagttagcaactgcaggggaagggaaaggctgtaacacccttcagctcagacgcacaatgggaatattaatttgagcagtttccatttcagtcccttgtcatgttaattttgaagtctggtatacgcccctcaattctagttgatgataagctctaaaagatggcaagattggtgaggccaaaatgcagctgacaaactgagcttacttagagattttcaaactatttgtaagactggcatctccaataacacttttgtcattcctgccattcaaacaggaactgttccctggaagacccttaaataaacctgtgctttcaacccactcacctgccagaggtggagcctgaaagaactggggtgtgggcttatcatcccagttgggtctcctttatttcccactggtgttttctgaccatgccagggaaagcaaacagtggctacattccagcccctccacagtcaactaagtttcattcttccctctggctgagggtctgttggaggtgagcccag

SEQ ID NO: 3 - DNA, 643 bp, synthetic construct
  misc_feature 1..643: note = synthetic oligonucleotide
  source 1..643: mol_type = other DNA
gatcctgtgtgccttctcctgccatggtacacacactcacacaccccctcatacacaagtcctttgttgagccctgaggcaggaaatgggaaattcaaaaggaagagcctgagaaaccattttatttcatttcagggggcttctcaccatcccttgaaggaggcagccccaagtgatatagaccagaacccctctcacagagtcttagttcacatcctagatataaaacagagaacttccggggcttagaagttttgtctgttgggggaaatctctgcaggctcaaaaagtaacccagggttggccttatgggtgtggtggatttgtgtttcagtgaagtgaacacagaaaagaggtgagtatatatgtacacacagaaatcacaggaaaaaactccaaaaactcacttgtgctaagtcttgagggccagtccagcagaaagatacttgcctttctccttcagacttcgttgtcagtctcgttttctttgtcctgtggagtagcggggagatttggagttcatgaggatggacgcacaggcagtatgtgccccaaagcccttgaccaggcagtaatgggggcctcaggaatagctagggctgtttcctcagagaactggtcatgtgaaaggacaaaggctttg

SEQ ID NO: 4 - DNA, 20 bp, synthetic construct
  misc_feature 1..20: note = synthetic oligonucleotide
  source 1..20: mol_type = other DNA
ggacaacgatgaggtctggt

SEQ ID NO: 5 - DNA, 20 bp, synthetic construct
  misc_feature 1..20: note = synthetic oligonucleotide
  source 1..20: mol_type = other DNA
tagggctggtgcttccatag

SEQ ID NO: 6 - DNA, 20 bp, synthetic construct
  misc_feature 1..20: note = synthetic oligonucleotide
  source 1..20: mol_type = other DNA
gcccctccacagtcaactaa

SEQ ID NO: 7 - DNA, 20 bp, synthetic construct
  misc_feature 1..20: note = synthetic oligonucleotide
  source 1..20: mol_type = other DNA
cgcttgtcctgaaggtcagt

SEQ ID NO: 8 - DNA, 20 bp, synthetic construct
  misc_feature 1..20: note = synthetic oligonucleotide
  source 1..20: mol_type = other DNA
ggcctcaggaatagctaggg

SEQ ID NO: 9 - DNA, 20 bp, synthetic construct
  misc_feature 1..20: note = synthetic oligonucleotide
  source 1..20: mol_type = other DNA
tgtgtatgagggggtgtgtg

SEQ ID NO: 10 - DNA, 20 bp, synthetic construct
  misc_feature 1..20: note = synthetic oligonucleotide
  source 1..20: mol_type = other DNA
tgatctagatcttgtgtccg

SEQ ID NO: 11 - DNA, 20 bp, synthetic construct
  misc_feature 1..20: note = synthetic oligonucleotide
  source 1..20: mol_type = other DNA
tgatctatcttcgacactgg

SEQ ID NO: 12 - DNA, 20 bp, synthetic construct
  misc_feature 1..20: note = synthetic oligonucleotide
  source 1..20: mol_type = other DNA
tgatcttcgagatggtgttc

SEQ ID NO: 13 - DNA, 20 bp, synthetic construct
  misc_feature 1..20: note = synthetic oligonucleotide
  source 1..20: mol_type = other DNA
tgatcttcggatagagagca

SEQ ID NO: 14 - DNA, 20 bp, synthetic construct
  misc_feature 1..20: note = synthetic oligonucleotide
  source 1..20: mol_type = other DNA
tgatcttcggtaccaacaac

SEQ ID NO: 15 - DNA, 20 bp, synthetic construct
  misc_feature 1..20: note = synthetic oligonucleotide
  source 1..20: mol_type = other DNA
tgatctccaaggtttggtga

SEQ ID NO: 16 - DNA, 20 bp, synthetic construct
  misc_feature 1..20: note = synthetic oligonucleotide
  source 1..20: mol_type = other DNA
tgatcttcgcaagaggtaag

SEQ ID NO: 17 - DNA, 20 bp, synthetic construct
  misc_feature 1..20: note = synthetic oligonucleotide
  source 1..20: mol_type = other DNA
tgatctggagttacggcttt

SEQ ID NO: 18 - DNA, 20 bp, synthetic construct
  misc_feature 1..20: note = synthetic oligonucleotide
  source 1..20: mol_type = other DNA
tgatcttcaaccagtaagcc

SEQ ID NO: 19 - DNA, 20 bp, synthetic construct
  misc_feature 1..20: note = synthetic oligonucleotide
  source 1..20: mol_type = other DNA
tgatctctgtaaacaacgcc

SEQ ID NO: 20 - DNA, 20 bp, synthetic construct
  misc_feature 1..20: note = synthetic oligonucleotide
  source 1..20: mol_type = other DNA
tgatctcacgatagtttgcc

SEQ ID NO: 21 - DNA, 20 bp, synthetic construct
  misc_feature 1..20: note = synthetic oligonucleotide
  source 1..20: mol_type = other DNA
tgatcttgtactaacacgcc

SEQ ID NO: 22 - DNA, 20 bp, synthetic construct
  misc_feature 1..20: note = synthetic oligonucleotide
  source 1..20: mol_type = other DNA
tgatctacgctaactccttg

SEQ ID NO: 23 - DNA, 20 bp, synthetic construct
  misc_feature 1..20: note = synthetic oligonucleotide
  source 1..20: mol_type = other DNA
tgatctcgtttacgatgtgg

SEQ ID NO: 24 - DNA, 20 bp, synthetic construct
  misc_feature 1..20: note = synthetic oligonucleotide
  source 1..20: mol_type = other DNA
tgatcttcttaggaaacgcc

SEQ ID NO: 25 - DNA, 20 bp, synthetic construct
  misc_feature 1..20: note = synthetic oligonucleotide
  source 1..20: mol_type = other DNA
tgatcttgcaatagacgacc

SEQ ID NO: 26 - DNA, 41 bp, synthetic construct
  misc_feature 1..41: note = synthetic oligonucleotide
  source 1..41: mol_type = other DNA
ccactacgcctccgctttcctctctatgggcagtcggtgat

SEQ ID NO: 27 - DNA, 20 bp, synthetic construct
  misc_feature 1..20: note = synthetic oligonucleotide
  source 1..20: mol_type = other DNA
ctgccccgggttcctcattc

SEQ ID NO: 28 - DNA, 27 bp, synthetic construct
  misc_feature 1..27: note = synthetic oligonucleotide
  source 1..27: mol_type = other DNA
ggagctcggacaacgatgaggtctggt

SEQ ID NO: 29 - DNA, 27 bp, synthetic construct
  misc_feature 1..27: note = synthetic oligonucleotide
  source 1..27: mol_type = other DNA
ggagctctagggctggtgcttccatag

SEQ ID NO: 30 - DNA, 27 bp, synthetic construct
  misc_feature 1..27: note = synthetic oligonucleotide
  source 1..27: mol_type = other DNA
ggagctcgcccctccacagtcaactaa

SEQ ID NO: 31 - DNA, 27 bp, synthetic construct
  misc_feature 1..27: note = synthetic oligonucleotide
  source 1..27: mol_type = other DNA
ggagctccgcttgtcctgaaggtcagt

SEQ ID NO: 32 - DNA, 27 bp, synthetic construct
  misc_feature 1..27: note = synthetic oligonucleotide
  source 1..27: mol_type = other DNA
ggagctcggcctcaggaatagctaggg

SEQ ID NO: 33 - DNA, 27 bp, synthetic construct
  misc_feature 1..27: note = synthetic oligonucleotide
  source 1..27: mol_type = other DNA
ggagctctgtgtatgagggggtgtgtg

SEQ ID NO: 34 - DNA, 29 bp, synthetic construct
  misc_feature 1..29: note = synthetic oligonucleotide
  source 1..29: mol_type = other DNA
ttcctctctatgggcagtcggtgatcgaa

SEQ ID NO: 35 - DNA, 33 bp, synthetic construct
  misc_feature 1..33: note = synthetic oligonucleotide
  source 1..33: mol_type = other DNA
gatcttcgatcaccgactgcccatagagaggaa

SEQ ID NO: 36 - DNA, 29 bp, synthetic construct
  misc_feature 1..29: note = synthetic oligonucleotide
  source 1..29: mol_type = other DNA
ttcctctctatgggcagtcggtgatgttg

SEQ ID NO: 37 - DNA, 33 bp, synthetic construct
  misc_feature 1..33: note = synthetic oligonucleotide
  source 1..33: mol_type = other DNA
gatccaacatcaccgactgcccatagagaggaa

SEQ ID NO: 38 - DNA, 29 bp, synthetic construct
  misc_feature 1..29: note = synthetic oligonucleotide
  source 1..29: mol_type = other DNA
ttcctctctatgggcagtcggtgataaga

SEQ ID NO: 39 - DNA, 33 bp, synthetic construct
  misc_feature 1..33: note = synthetic oligonucleotide
  source 1..33: mol_type = other DNA
gatctcttatcaccgactgcccatagagaggaa

SEQ ID NO: 40 - DNA, 29 bp, synthetic construct
  misc_feature 1..29: note = synthetic oligonucleotide
  source 1..29: mol_type = other DNA
ttcctctctatgggcagtcggtgattttc

SEQ ID NO: 41 - DNA, 33 bp, synthetic construct
  misc_feature 1..33: note = synthetic oligonucleotide
  source 1..33: mol_type = other DNA
gatcgaaaatcaccgactgcccatagagaggaa

SEQ ID NO: 42 - DNA, 29 bp, synthetic construct
  misc_feature 1..29: note = synthetic oligonucleotide
  source 1..29: mol_type = other DNA
ttcctctctatgggcagtcggtgattacc

SEQ ID NO: 43 - DNA, 33 bp, synthetic construct
  misc_feature 1..33: note = synthetic oligonucleotide
  source 1..33: mol_type = other DNA
gatcggtaatcaccgactgcccatagagaggaa

SEQ ID NO: 44 - DNA, 32 bp, synthetic construct
  misc_feature 1..32: note = synthetic oligonucleotide
  source 1..32: mol_type = other DNA
cgacagacgcctgatcttttgttagccggagt

SEQ ID NO: 45 - DNA, 25 bp, synthetic construct
  misc_feature 1..25: note = synthetic oligonucleotide
  source 1..25: mol_type = other DNA
gatcactccggctaacaaaagatca

SEQ ID NO: 46 - DNA, 32 bp, synthetic construct
  misc_feature 1..32: note = synthetic oligonucleotide
  source 1..32: mol_type = other DNA
cgacagacgcctgatcttttctcgaccactgt

SEQ ID NO: 47 - DNA, 25 bp, synthetic construct
  misc_feature 1..25: note = synthetic oligonucleotide
  source 1..25: mol_type = other DNA
gatcacagtggtcgagaaaagatca

SEQ ID NO: 48 - DNA, 32 bp, synthetic construct
  misc_feature 1..32: note = synthetic oligonucleotide
  source 1..32: mol_type = other DNA
cgacagacgcctgatcttttctagctaccgct

SEQ ID NO: 49 - DNA, 25 bp, synthetic construct
  misc_feature 1..25: note = synthetic oligonucleotide
  source 1..25: mol_type = other DNA
gatcagcggtagctagaaaagatca

SEQ ID NO: 50 - DNA, 32 bp, synthetic construct
  misc_feature 1..32: note = synthetic oligonucleotide
  source 1..32: mol_type = other DNA
cgacagacgcctgatcttttcgttaggaggct

SEQ ID NO: 51 - DNA, 25 bp, synthetic construct
  misc_feature 1..25: note = synthetic oligonucleotide
  source 1..25: mol_type = other DNA
gatcagcctcctaacgaaaagatca

SEQ ID NO: 52 - DNA, 32 bp, synthetic construct
  misc_feature 1..32: note = synthetic oligonucleotide
  source 1..32: mol_type = other DNA
cgacagacgcctgatcttttcctgaacgacct

SEQ ID NO: 53 - DNA, 25 bp, synthetic construct
  misc_feature 1..25: note = synthetic oligonucleotide
  source 1..25: mol_type = other DNA
gatcaggtcgttcaggaaaagatca

SEQ ID NO: 54 - DNA, 32 bp, synthetic construct
  misc_feature 1..32: note = synthetic oligonucleotide
  source 1..32: mol_type = other DNA
cgacagacgcctgatcttttccatagcgtcct

SEQ ID NO: 55 - DNA, 25 bp, synthetic construct
  misc_feature 1..25: note = synthetic oligonucleotide
  source 1..25: mol_type = other DNA
gatcaggacgctatggaaaagatca

SEQ ID NO: 56 - DNA, 32 bp, synthetic construct
  misc_feature 1..32: note = synthetic oligonucleotide
  source 1..32: mol_type = other DNA
cgacagacgcctgatcttttcactacggctct

SEQ ID NO: 57 - DNA, 25 bp, synthetic construct
  misc_feature 1..25: note = synthetic oligonucleotide
  source 1..25: mol_type = other DNA
gatcagagccgtagtgaaaagatca

SEQ ID NO: 58 - DNA, 32 bp, synthetic construct
  misc_feature 1..32: note = synthetic oligonucleotide
  source 1..32: mol_type = other DNA
cgacagacgcctgatcttttcaccagtccagt

SEQ ID NO: 59 - DNA, 25 bp, synthetic construct
  misc_feature 1..25: note = synthetic oligonucleotide
  source 1..25: mol_type = other DNA
gatcactggactggtgaaaagatca

SEQ ID NO: 60 - DNA, 32 bp, synthetic construct
  misc_feature 1..32: note = synthetic oligonucleotide
  source 1..32: mol_type = other DNA
cgacagacgcctgatcttttactgcgacctct

SEQ ID NO: 61 - DNA, 25 bp, synthetic construct
  misc_feature 1..25: note = synthetic oligonucleotide
  source 1..25: mol_type = other DNA
gatcagaggtcgcagtaaaagatca

SEQ ID NO: 62 - DNA, 32 bp, synthetic construct
  misc_feature 1..32: note = synthetic oligonucleotide
  source 1..32: mol_type = other DNA
cgacagacgcctgatcttttacgcctctgact

SEQ ID NO: 63 - DNA, 25 bp, synthetic construct
  misc_feature 1..25: note = synthetic oligonucleotide
  source 1..25: mol_type = other DNA
gatcagtcagaggcgtaaaagatca

SEQ ID NO: 64 - DNA, 32 bp, synthetic construct
  misc_feature 1..32: note = synthetic oligonucleotide
  source 1..32: mol_type = other DNA
cgacagacgcctgatcttttacctggactgct

SEQ ID NO: 65 - DNA, 25 bp, synthetic construct
  misc_feature 1..25: note = synthetic oligonucleotide
  source 1..25: mol_type = other DNA
gatcagcagtccaggtaaaagatca

SEQ ID NO: 66 - DNA, 32 bp, synthetic construct
  misc_feature 1..32: note = synthetic oligonucleotide
  source 1..32: mol_type = other DNA
cgacagacgcctgatcttttacaggagagcgt

SEQ ID NO: 67 - DNA, 25 bp, synthetic construct
  misc_feature 1..25: note = synthetic oligonucleotide
  source 1..25: mol_type = other DNA
gatcacgctctcctgtaaaagatca

SEQ ID NO: 68 - DNA, 32 bp, synthetic construct
  misc_feature 1..32: note = synthetic oligonucleotide
  source 1..32: mol_type = other DNA
cgacagacgcctgatcttttaactgaggcggt

SEQ ID NO: 69 - DNA, 25 bp, synthetic construct
  misc_feature 1..25: note = synthetic oligonucleotide
  source 1..25: mol_type = other DNA
gatcaccgcctcagttaaaagatca

SEQ ID NO: 70 - DNA, 32 bp, synthetic construct
  misc_feature 1..32: note = synthetic oligonucleotide
  source 1..32: mol_type = other DNA
cgacagacgcctgatcttttaaccaggagcgt

SEQ ID NO: 71 - DNA, 25 bp, synthetic construct
  misc_feature 1..25: note = synthetic oligonucleotide
  source 1..25: mol_type = other DNA
gatcacgctcctggttaaaagatca

SEQ ID NO: 72 - DNA, 32 bp, synthetic construct
  misc_feature 1..32: note = synthetic oligonucleotide
  source 1..32: mol_type = other DNA
cgacagacgcctgatctttgttccacctcagt

SEQ ID NO: 73 - DNA, 25 bp, synthetic construct
  misc_feature 1..25: note = synthetic oligonucleotide
  source 1..25: mol_type = other DNA
gatcactgaggtggaacaaagatca

SEQ ID NO: 74 - DNA, 32 bp, synthetic construct
  misc_feature 1..32: note = synthetic oligonucleotide
  source 1..32: mol_type = other DNA
cgacagacgcctgatctttgttaggcaggtct

SEQ ID NO: 75 - DNA, 25 bp, synthetic construct
  misc_feature 1..25: note = synthetic oligonucleotide
  source 1..25: mol_type = other DNA
gatcagacctgcctaacaaagatca

SEQ ID NO: 76 - DNA, 32 bp, synthetic construct
  misc_feature 1..32: note = synthetic oligonucleotide
  source 1..32: mol_type = other DNA
cgacagacgcctgatctttgtgtagaccgtgt

SEQ ID NO: 77 - DNA, 25 bp, synthetic construct
  misc_feature 1..25: note = synthetic oligonucleotide
  source 1..25: mol_type = other DNA
gatcacacggtctacacaaagatca

SEQ ID NO: 78 - DNA, 32 bp, synthetic construct
  misc_feature 1..32: note = synthetic oligonucleotide
  source 1..32: mol_type = other DNA
cgacagacgcctgatctttgtatcctcacgct

SEQ ID NO: 79 - DNA, 25 bp, synthetic construct
  misc_feature 1..25: note = synthetic oligonucleotide
  source 1..25: mol_type = other DNA
gatcagcgtgaggatacaaagatca

SEQ ID NO: 80 - DNA, 32 bp, synthetic construct
  misc_feature 1..32: note = synthetic oligonucleotide
  source 1..32: mol_type = other DNA
cgacagacgcctgatctttgtagacagagcgt

SEQ ID NO: 81 - DNA, 25 bp, synthetic construct
  misc_feature 1..25: note = synthetic oligonucleotide
  source 1..25: mol_type = other DNA
gatcacgctctgtctacaaagatca

SEQ ID NO: 82 - DNA, 32 bp, synthetic construct
  misc_feature 1..32: note = synthetic oligonucleotide
  source 1..32: mol_type = other DNA
cgacagacgcctgatctttgtacgtgtaggct

SEQ ID NO: 83 - DNA, 25 bp, synthetic construct
  misc_feature 1..25: note = synthetic oligonucleotide
  source 1..25: mol_type = other DNA
gatcagcctacacgtacaaagatca

SEQ ID NO: 84 - DNA, 32 bp, synthetic construct
  misc_feature 1..32: note = synthetic oligonucleotide
  source 1..32: mol_type = other DNA
cgacagacgcctgatctttggttaaggctcgt

SEQ ID NO: 85 - DNA, 25 bp, synthetic construct
  misc_feature 1..25: note = synthetic oligonucleotide
  source 1..25: mol_type = other DNA
gatcacgagccttaaccaaagatca

SEQ ID NO: 86 - DNA, 32 bp, synthetic construct
  misc_feature 1..32: note = synthetic oligonucleotide
  source 1..32: mol_type = other DNA
cgacagacgcctgatctttggtctcaaggtgt

SEQ ID NO: 87 - DNA, 25 bp, synthetic construct
  misc_feature 1..25: note = synthetic oligonucleotide
  source 1..25: mol_type = other DNA
gatcacaccttgagaccaaagatca

SEQ ID NO: 88 - DNA, 32 bp, synthetic construct
  misc_feature 1..32: note = synthetic oligonucleotide
  source 1..32: mol_type = other DNA
cgacagacgcctgatctttggagagaacagct

SEQ ID NO: 89 - DNA, 25 bp, synthetic construct
  misc_feature 1..25: note = synthetic oligonucleotide
  source 1..25: mol_type = other DNA
gatcagctgttctctccaaagatca

SEQ ID NO: 90 - DNA, 32 bp, synthetic construct
  misc_feature 1..32: note = synthetic oligonucleotide
  source 1..32: mol_type = other DNA
cgacagacgcctgatctttggaatctgctggt

SEQ ID NO: 91 - DNA, 25 bp, synthetic construct
  misc_feature 1..25: note = synthetic oligonucleotide
  source 1..25: mol_type = other DNA
gatcaccagcagattccaaagatca

SEQ ID NO: 92 - DNA, 32 bp, synthetic construct
  misc_feature 1..32: note = synthetic oligonucleotide
  source 1..32: mol_type = other DNA
cgacagacgcctgatctttggaatcaggacgt

SEQ ID NO: 93 - DNA, 25 bp, synthetic construct
  misc_feature 1..25: note = synthetic oligonucleotide
  source 1..25: mol_type = other DNA
gatcacgtcctgattccaaagatca

SEQ ID NO: 94 - DNA, 32 bp, synthetic construct
  misc_feature 1..32: note = synthetic oligonucleotide
  source 1..32: mol_type = other DNA
cgacagacgcctgatctttggaagacgagact

SEQ ID NO: 95 - DNA, 25 bp, synthetic construct
  misc_feature 1..25: note = synthetic oligonucleotide
  source 1..25: mol_type = other DNA
gatcagtctcgtcttccaaagatca

SEQ ID NO: 96 - DNA, 32 bp, synthetic construct
  misc_feature 1..32: note = synthetic oligonucleotide
  source 1..32: mol_type = other DNA
cgacagacgcctgatctttgctctactcacgt

SEQ ID NO: 97 - DNA, 25 bp, synthetic construct
  misc_feature 1..25: note = synthetic oligonucleotide
  source 1..25: mol_type = other DNA
gatcacgtgagtagagcaaagatca

SEQ ID NO: 98 - DNA, 32 bp, synthetic construct
  misc_feature 1..32: note = synthetic oligonucleotide
  source 1..32: mol_type = other DNA
cgacagacgcctgatctttgctaaccaggact

SEQ ID NO: 99 - DNA, 25 bp, synthetic construct
  misc_feature 1..25: note = synthetic oligonucleotide
  source 1..25: mol_type = other DNA
gatcagtcctggttagcaaagatca

SEQ ID NO: 100 - DNA, 32 bp, synthetic construct
  misc_feature 1..32: note = synthetic oligonucleotide
  source 1..32: mol_type = other DNA
cgacagacgcctgatctttgcgtgagagatct

SEQ ID NO: 101 - DNA, 25 bp, synthetic construct
  misc_feature 1..25: note = synthetic oligonucleotide
  source 1..25: mol_type = other DNA
gatcagatctctcacgcaaagatca

SEQ ID NO: 102 - DNA, 32 bp, synthetic construct
  misc_feature 1..32: note = synthetic oligonucleotide
  source 1..32: mol_type = other DNA
cgacagacgcctgatctttgcatctcaccagt

SEQ ID NO: 103 - DNA, 25 bp, synthetic construct
  misc_feature 1..25: note = synthetic oligonucleotide
  source 1..25: mol_type = other DNA
gatcactggtgagatgcaaagatca

SEQ ID NO: 104 - DNA, 32 bp, synthetic construct
  misc_feature 1..32: note = synthetic oligonucleotide
  source 1..32: mol_type = other DNA
cgacagacgcctgatctttgcagatgaggact

SEQ ID NO: 105 - DNA, 25 bp, synthetic construct
  misc_feature 1..25: note = synthetic oligonucleotide
  source 1..25: mol_type = other DNA
gatcagtcctcatctgcaaagatca

SEQ ID NO: 106 - DNA, 32 bp, synthetic construct
  misc_feature 1..32: note = synthetic oligonucleotide
  source 1..32: mol_type = other DNA
cgacagacgcctgatctttgatgtgagcctgt

SEQ ID NO: 107 - DNA, 25 bp, synthetic construct
  misc_feature 1..25: note = synthetic oligonucleotide
  source 1..25: mol_type = other DNA
gatcacaggctcacatcaaagatca

SEQ ID NO: 108 - DNA, 32 bp, synthetic construct
  misc_feature 1..32: note = synthetic oligonucleotide
  source 1..32: mol_type = other DNA
cgacagacgcctgatctttgatggaacggact

SEQ ID NO: 109 - DNA, 25 bp, synthetic construct
  misc_feature 1..25: note = synthetic oligonucleotide
  source 1..25: mol_type = other DNA
gatcagtccgttccatcaaagatca

SEQ ID NO: 110 - DNA, 32 bp, synthetic construct
  misc_feature 1..32: note = synthetic oligonucleotide
  source 1..32: mol_type = other DNA
cgacagacgcctgatctttgagcacaaggagt

SEQ ID NO: 111 - DNA, 25 bp, synthetic construct
  misc_feature 1..25: note = synthetic oligonucleotide
  source 1..25: mol_type = other DNA
gatcactccttgtgctcaaagatca

SEQ ID NO: 112 - DNA, 32 bp, synthetic construct
  misc_feature 1..32: note = synthetic oligonucleotide
  source 1..32: mol_type = other DNA
cgacagacgcctgatctttgacgtatggagct

SEQ ID NO: 113 - DNA, 25 bp, synthetic construct
  misc_feature 1..25: note = synthetic oligonucleotide
  source 1..25: mol_type = other DNA
gatcagctccatacgtcaaagatca

SEQ ID NO: 114 - DNA, 32 bp, synthetic construct
  misc_feature 1..32: note = synthetic oligonucleotide
  source 1..32: mol_type = other DNA
cgacagacgcctgatctttgacggagatgact

SEQ ID NO: 115 - DNA, 25 bp, synthetic construct
  misc_feature 1..25: note = synthetic oligonucleotide
  source 1..25: mol_type = other DNA
gatcagtcatctccgtcaaagatca

SEQ ID NO: 116 - DNA, 32 bp, synthetic construct
  misc_feature 1..32: note = synthetic oligonucleotide
  source 1..32: mol_type = other DNA
cgacagacgcctgatctttgacacgaagaggt

SEQ ID NO: 117 - DNA, 25 bp, synthetic construct
  misc_feature 1..25: note = synthetic oligonucleotide
  source 1..25: mol_type = other DNA
gatcacctcttcgtgtcaaagatca

SEQ ID NO: 118 - DNA, 32 bp, synthetic construct
  misc_feature 1..32: note = synthetic oligonucleotide
  source 1..32: mol_type = other DNA
cgacagacgcctgatctttcttggagtagcgt

SEQ ID NO: 119 - DNA, 25 bp, synthetic construct
  misc_feature 1..25: note = synthetic oligonucleotide
  source 1..25: mol_type = other DNA
gatcacgctactccaagaaagatca

SEQ ID NO: 120 - DNA, 32 bp, synthetic construct
  misc_feature 1..32: note = synthetic oligonucleotide
  source 1..32: mol_type = other DNA
cgacagacgcctgatctttctgagtgtgacgt

SEQ ID NO: 121 - DNA, 25 bp, synthetic construct
  misc_feature 1..25: note = synthetic oligonucleotide
  source 1..25: mol_type = other DNA
gatcacgtcacactcagaaagatca

SEQ ID NO: 122 - DNA, 32 bp, synthetic construct
  misc_feature 1..32: note = synthetic oligonucleotide
  source 1..32: mol_type = other DNA
cgacagacgcctgatctttctccgacacttgt

SEQ ID NO: 123 - DNA, 25 bp, synthetic construct
  misc_feature 1..25: note = synthetic oligonucleotide
  source 1..25: mol_type = other DNA
gatcacaagtgtcggagaaagatca

SEQ ID NO: 124 - DNA, 32 bp, synthetic construct
  misc_feature 1..32: note = synthetic oligonucleotide
  source 1..32: mol_type = other DNA
cgacagacgcctgatctttcgaggttgacagt

SEQ ID NO: 125 - DNA, 25 bp, synthetic construct
  misc_feature 1..25: note = synthetic oligonucleotide
  source 1..25: mol_type = other DNA
gatcactgtcaacctcgaaagatca

SEQ ID NO: 126 - DNA, 32 bp, synthetic construct
  misc_feature 1..32: note = synthetic oligonucleotide
  source 1..32: mol_type = other DNA
cgacagacgcctgatctttcgaagagaacggt

SEQ ID NO: 127 - DNA, 25 bp, synthetic construct
  misc_feature 1..25: note = synthetic oligonucleotide
  source 1..25: mol_type = other DNA
gatcaccgttctcttcgaaagatca

SEQ ID NO: 128 - DNA, 32 bp, synthetic construct
  misc_feature 1..32: note = synthetic oligonucleotide
  source 1..32: mol_type = other DNA
cgacagacgcctgatctttccttcaactcggt

SEQ ID NO: 129 - DNA, 25 bp, synthetic construct
  misc_feature 1..25: note = synthetic oligonucleotide
  source 1..25: mol_type = other DNA
gatcaccgagttgaaggaaagatca

SEQ ID NO: 130 - DNA, 32 bp, synthetic construct
  misc_feature 1..32: note = synthetic oligonucleotide
  source 1..32: mol_type = other DNA
cgacagacgcctgatctttcctggagacactt

SEQ ID NO: 131 - DNA, 25 bp, synthetic construct
  misc_feature 1..25: note = synthetic oligonucleotide
  source 1..25: mol_type = other DNA
gatcaagtgtctccaggaaagatca

SEQ ID NO: 132 - DNA, 32 bp, synthetic construct
  misc_feature 1..32: note = synthetic oligonucleotide
  source 1..32: mol_type = other DNA
cgacagacgcctgatctttcctctgaaaccgt

SEQ ID NO: 133 - DNA, 25 bp, synthetic construct
  misc_feature 1..25: note = synthetic oligonucleotide
  source 1..25: mol_type = other DNA
gatcacggtttcagaggaaagatca

SEQ ID NO: 134 - DNA, 32 bp, synthetic construct
  misc_feature 1..32: note = synthetic oligonucleotide
  source 1..32: mol_type = other DNA
cgacagacgcctgatctttcctattgaccgct

SEQ ID NO: 135 - DNA, 25 bp, synthetic construct
  misc_feature 1..25: note = synthetic oligonucleotide
  source 1..25: mol_type = other DNA
gatcagcggtcaataggaaagatca

SEQ ID NO: 136 - DNA, 32 bp, synthetic construct
  misc_feature 1..32: note = synthetic oligonucleotide
  source 1..32: mol_type = other DNA
cgacagacgcctgatctttccggtgatgatgt

SEQ ID NO: 137 - DNA, 25 bp, synthetic construct
  misc_feature 1..25: note = synthetic oligonucleotide
  source 1..25: mol_type = other DNA
gatcacatcatcaccggaaagatca

SEQ ID NO: 138 - DNA, 32 bp, synthetic construct
  misc_feature 1..32: note = synthetic oligonucleotide
  source 1..32: mol_type = other DNA
cgacagacgcctgatctttccgacaagactct

SEQ ID NO: 139 - DNA, 25 bp, synthetic construct
  misc_feature 1..25: note = synthetic oligonucleotide
  source 1..25: mol_type = other DNA
gatcagagtcttgtcggaaagatca

SEQ ID NO: 140 - DNA, 32 bp, synthetic construct
  misc_feature 1..32: note = synthetic oligonucleotide
  source 1..32: mol_type = other DNA
cgacagacgcctgatctttccatgtcgagtct

SEQ ID NO: 141 - DNA, 25 bp, synthetic construct
  misc_feature 1..25: note = synthetic oligonucleotide
  source 1..25: mol_type = other DNA
gatcagactcgacatggaaagatca

SEQ ID NO: 142 - DNA, 32 bp, synthetic construct
  misc_feature 1..32: note = synthetic oligonucleotide
  source 1..32: mol_type = other DNA
cgacagacgcctgatctttccacgttagtcct

SEQ ID NO: 143 - DNA, 25 bp, synthetic construct
  misc_feature 1..25: note = synthetic oligonucleotide
  source 1..25: mol_type = other DNA
gatcaggactaacgtggaaagatca

SEQ ID NO: 144 - DNA, 32 bp, synthetic construct
  misc_feature 1..32: note = synthetic oligonucleotide
  source 1..32: mol_type = other DNA
cgacagacgcctgatctttccaagaagccagt

SEQ ID NO: 145 - DNA, 25 bp, synthetic construct
  misc_feature 1..25: note = synthetic oligonucleotide
  source 1..25: mol_type = other DNA
gatcactggcttcttggaaagatca

SEQ ID NO: 146 - DNA, 32 bp, synthetic construct
  misc_feature 1..32: note = synthetic oligonucleotide
  source 1..32: mol_type = other DNA
cgacagacgcctgatctttcatgaaggacggt

SEQ ID NO: 147 - DNA, 25 bp, synthetic construct
  misc_feature 1..25: note = synthetic oligonucleotide
  source 1..25: mol_type = other DNA
gatcaccgtccttcatgaaagatca

SEQ ID NO: 148 - DNA, 32 bp, synthetic construct
  misc_feature 1..32: note = synthetic oligonucleotide
  source 1..32: mol_type = other DNA
cgacagacgcctgatctttcataaccgagcct

SEQ ID NO: 149 - DNA, 25 bp, synthetic construct
  misc_feature 1..25: note = synthetic oligonucleotide
  source 1..25: mol_type = other DNA
gatcaggctcggttatgaaagatca

SEQ ID NO: 150 - DNA, 32 bp, synthetic construct
  misc_feature 1..32: note = synthetic oligonucleotide
  source 1..32: mol_type = other DNA
cgacagacgcctgatctttcaggttggtagct

SEQ ID NO: 151 - DNA, 25 bp, synthetic construct
  misc_feature 1..25: note = synthetic oligonucleotide
  source 1..25: mol_type = other DNA
gatcagctaccaacctgaaagatca

SEQ ID NO: 152 - DNA, 32 bp, synthetic construct
  misc_feature 1..32: note = synthetic oligonucleotide
  source 1..32: mol_type = other DNA
cgacagacgcctgatctttcaggagccaatct

SEQ ID NO: 153 - DNA, 25 bp, synthetic construct
  misc_feature 1..25: note = synthetic oligonucleotide
  source 1..25: mol_type = other DNA
gatcagattggctcctgaaagatca

SEQ ID NO: 154 - DNA, 32 bp, synthetic construct
  misc_feature 1..32: note = synthetic oligonucleotide
  source 1..32: mol_type = other DNA
cgacagacgcctgatctttcaccggatcttct

SEQ ID NO: 155 - DNA, 25 bp, synthetic construct
  misc_feature 1..25: note = synthetic oligonucleotide
  source 1..25: mol_type = other DNA
gatcagaagatccggtgaaagatca

SEQ ID NO: 156 - DNA, 32 bp, synthetic construct
  misc_feature 1..32: note = synthetic oligonucleotide
  source 1..32: mol_type = other DNA
cgacagacgcctgatctttcaagtggagacgt

SEQ ID NO: 157 - DNA, 25 bp, synthetic construct
  misc_feature 1..25: note = synthetic oligonucleotide
  source 1..25: mol_type = other DNA
gatcacgtctccacttgaaagatca

SEQ ID NO: 158 - DNA, 32 bp, synthetic construct
  misc_feature 1..32: note = synthetic oligonucleotide
  source 1..32: mol_type = other DNA
cgacagacgcctgatctttcaaacggagaggt

SEQ ID NO: 159 - DNA, 25 bp, synthetic construct
  misc_feature 1..25: note = synthetic oligonucleotide
  source 1..25: mol_type = other DNA
gatcacctctccgtttgaaagatca

SEQ ID NO: 160 - DNA, 32 bp, synthetic construct
  misc_feature 1..32: note = synthetic oligonucleotide
  source 1..32: mol_type = other DNA
cgacagacgcctgatctttatgtcagaggcgt

SEQ ID NO: 161 - DNA, 25 bp, synthetic construct
  misc_feature 1..25: note = synthetic oligonucleotide
  source 1..25: mol_type = other DNA
gatcacgcctctgacataaagatca

SEQ ID NO: 162 - DNA, 32 bp, synthetic construct
  misc_feature 1..32: note = synthetic oligonucleotide
  source 1..32: mol_type = other DNA
cgacagacgcctgatctttatgtacgctcggt

SEQ ID NO: 163 - DNA, 25 bp, synthetic construct
  misc_feature 1..25: note = synthetic oligonucleotide
  source 1..25: mol_type = other DNA
gatcaccgagcgtacataaagatca

SEQ ID NO: 164 - DNA, 32 bp, synthetic construct
  misc_feature 1..32: note = synthetic oligonucleotide
  source 1..32: mol_type = other DNA
cgacagacgcctgatctttatggcgtggatct

SEQ ID NO: 165 - DNA, 25 bp, synthetic construct
  misc_feature 1..25: note = synthetic oligonucleotide
  source 1..25: mol_type = other DNA
gatcagatccacgccataaagatca

SEQ ID NO: 166 - DNA, 32 bp, synthetic construct
  misc_feature 1..32: note = synthetic oligonucleotide
  source 1..32: mol_type = other DNA
cgacagacgcctgatctttatgagcgacgagt

SEQ ID NO: 167 - DNA, 25 bp, synthetic construct
  misc_feature 1..25: note = synthetic oligonucleotide
  source 1..25: mol_type = other DNA
gatcactcgtcgctcataaagatca

SEQ ID NO: 168 - DNA, 32 bp, synthetic construct
  misc_feature 1..32: note = synthetic oligonucleotide
  source 1..32: mol_type = other DNA
cgacagacgcctgatctttatccacgacagct

SEQ ID NO: 169 - DNA, 25 bp, synthetic construct
  misc_feature 1..25: note = synthetic oligonucleotide
  source 1..25: mol_type = other DNA
gatcagctgtcgtggataaagatca

SEQ ID NO: 170 - DNA, 32 bp, synthetic construct
  misc_feature 1..32: note = synthetic oligonucleotide
  source 1..32: mol_type = other DNA
cgacagacgcctgatctttatagtcgcgtggt

SEQ ID NO: 171 - DNA, 25 bp, synthetic construct
  misc_feature 1..25: note = synthetic oligonucleotide
  source 1..25: mol_type = other DNA
gatcaccacgcgactataaagatca

SEQ ID NO: 172 - DNA, 32 bp, synthetic construct
  misc_feature 1..32: note = synthetic oligonucleotide
  source 1..32: mol_type = other DNA
cgacagacgcctgatctttataaggccaccgt

SEQ ID NO: 173 - DNA, 25 bp, synthetic construct
  misc_feature 1..25: note = synthetic oligonucleotide
  source 1..25: mol_type = other DNA
gatcacggtggccttataaagatca

SEQ ID NO: 174 - DNA, 32 bp, synthetic construct
  misc_feature 1..32: note = synthetic oligonucleotide
  source 1..32: mol_type = other DNA
cgacagacgcctgatctttagtttcggcaggt

SEQ ID NO: 175 - DNA, 25 bp, synthetic construct
  misc_feature 1..25: note = synthetic oligonucleotide
  source 1..25: mol_type = other DNA
gatcacctgccgaaactaaagatca

SEQ ID NO: 176 - DNA, 32 bp, synthetic construct
  misc_feature 1..32: note = synthetic oligonucleotide
  source 1..32: mol_type = other DNA
cgacagacgcctgatctttagtgtactggcgt

SEQ ID NO: 177 - DNA, 25 bp, synthetic construct
  misc_feature 1..25: note = synthetic oligonucleotide
  source 1..25: mol_type = other DNA
gatcacgccagtacactaaagatca

SEQ ID NO: 178 - DNA, 32 bp, synthetic construct
  misc_feature 1..32: note = synthetic oligonucleotide
  source 1..32: mol_type = other DNA
cgacagacgcctgatctttagtctccaccgat

SEQ ID NO: 179 - DNA, 25 bp, synthetic construct
  misc_feature 1..25: note = synthetic oligonucleotide
  source 1..25: mol_type = other DNA
gatcatcggtggagactaaagatca

SEQ ID NO: 180 - DNA, 32 bp, synthetic construct
  misc_feature 1..32: note = synthetic oligonucleotide
  source 1..32: mol_type = other DNA
cgacagacgcctgatctttagtatgctcgcct

SEQ ID NO: 181 - DNA, 25 bp, synthetic construct
  misc_feature 1..25: note = synthetic oligonucleotide
  source 1..25: mol_type = other DNA
gatcaggcgagcatactaaagatca

SEQ ID NO: 182 - DNA, 32 bp, synthetic construct
  misc_feature 1..32: note = synthetic oligonucleotide
  source 1..32: mol_type = other DNA
cgacagacgcctgatctttagcctccaatcgt

SEQ ID NO: 183 - DNA, 25 bp, synthetic construct
  misc_feature 1..25: note = synthetic oligonucleotide
  source 1..25: mol_type = other DNA
gatcacgattggaggctaaagatca

SEQ ID NO: 184 - DNA, 32 bp, synthetic construct
  misc_feature 1..32: note = synthetic oligonucleotide
  source 1..32: mol_type = other DNA
cgacagacgcctgatctttagaactctggcgt

SEQ ID NO: 185 - DNA, 25 bp, synthetic construct
  misc_feature 1..25: note = synthetic oligonucleotide
  source 1..25: mol_type = other DNA
gatcacgccagagttctaaagatca

SEQ ID NO: 186 - DNA, 32 bp, synthetic construct
  misc_feature 1..32: note = synthetic oligonucleotide
  source 1..32: mol_type = other DNA
cgacagacgcctgatctttagaacgcgagagt

SEQ ID NO: 187 - DNA, 25 bp, synthetic construct
  misc_feature 1..25: note = synthetic oligonucleotide
  source 1..25: mol_type = other DNA
gatcactctcgcgttctaaagatca

SEQ ID NO: 188 - DNA, 32 bp, synthetic construct
  misc_feature 1..32: note = synthetic oligonucleotide
  source 1..32: mol_type = other DNA
cgacagacgcctgatctttagaaccgacacct

SEQ ID NO: 189 - DNA, 25 bp, synthetic construct
  misc_feature 1..25: note = synthetic oligonucleotide
  source 1..25: mol_type = other DNA
gatcaggtgtcggttctaaagatca

SEQ ID NO: 190 - DNA, 32 bp, synthetic construct
  misc_feature 1..32: note = synthetic oligonucleotide
  source 1..32: mol_type = other DNA
cgacagacgcctgatctttactcagaaccgct

SEQ ID NO: 191 - DNA, 25 bp, synthetic construct
  misc_feature 1..25: note = synthetic oligonucleotide
  source 1..25: mol_type = other DNA
gatcagcggttctgagtaaagatca

SEQ ID NO: 192 - DNA, 32 bp, synthetic construct
  misc_feature 1..32: note = synthetic oligonucleotide
  source 1..32: mol_type = other DNA
cgacagacgcctgatctttacgagaggcaact

SEQ ID NO: 193 - DNA, 25 bp, synthetic construct
  misc_feature 1..25: note = synthetic oligonucleotide
  source 1..25: mol_type = other DNA
gatcagttgcctctcgtaaagatca

SEQ ID NO: 194 - DNA, 32 bp, synthetic construct
  misc_feature 1..32: note = synthetic oligonucleotide
  source 1..32: mol_type = other DNA
cgacagacgcctgatctttaccttggagcctt

SEQ ID NO: 195 - DNA, 25 bp, synthetic construct
  misc_feature 1..25: note = synthetic oligonucleotide
  source 1..25: mol_type = other DNA
gatcaaggctccaaggtaaagatca

SEQ ID NO: 196 - DNA, 32 bp, synthetic construct
  misc_feature 1..32: note = synthetic oligonucleotide
  source 1..32: mol_type = other DNA
cgacagacgcctgatctttaccagacaagcct

SEQ ID NO: 197 - DNA, 25 bp, synthetic construct
  misc_feature 1..25: note = synthetic oligonucleotide
  source 1..25: mol_type = other DNA
gatcaggcttgtctggtaaagatca

SEQ ID NO: 198 - DNA, 32 bp, synthetic construct
  misc_feature 1..32: note = synthetic oligonucleotide
  source 1..32: mol_type = other DNA
cgacagacgcctgatctttaaggcgagacagt

SEQ ID NO: 199 - DNA, 25 bp, synthetic construct
  misc_feature 1..25: note = synthetic oligonucleotide
  source 1..25: mol_type = other DNA
gatcactgtctcgccttaaagatca

SEQ ID NO: 200 - DNA, 32 bp, synthetic construct
  misc_feature 1..32: note = synthetic oligonucleotide
  source 1..32: mol_type = other DNA
cgacagacgcctgatctttaaggacgcaaggt

SEQ ID NO: 201 - DNA, 25 bp, synthetic construct
  misc_feature 1..25: note = synthetic oligonucleotide
  source 1..25: mol_type = other DNA
gatcaccttgcgtccttaaagatca

SEQ ID NO: 202 - DNA, 32 bp, synthetic construct
  misc_feature 1..32: note = synthetic oligonucleotide
  source 1..32: mol_type = other DNA
cgacagacgcctgatctttaagcggaactggt

SEQ ID NO: 203 - DNA, 25 bp, synthetic construct
  misc_feature 1..25: note = synthetic oligonucleotide
  source 1..25: mol_type = other DNA
gatcaccagttccgcttaaagatca

SEQ ID NO: 204 - DNA, 32 bp, synthetic construct
  misc_feature 1..32: note = synthetic oligonucleotide
  source 1..32: mol_type = other DNA
cgacagacgcctgatctttaagccatctccgt

SEQ ID NO: 205 - DNA, 25 bp, synthetic construct
  misc_feature 1..25: note = synthetic oligonucleotide
  source 1..25: mol_type = other DNA
gatcacggagatggcttaaagatca

SEQ ID NO: 206 - DNA, 32 bp, synthetic construct
  misc_feature 1..32: note = synthetic oligonucleotide
  source 1..32: mol_type = other DNA
cgacagacgcctgatctttaacgatcctgcct

SEQ ID NO: 207 - DNA, 25 bp, synthetic construct
  misc_feature 1..25: note = synthetic oligonucleotide
  source 1..25: mol_type = other DNA
gatcaggcaggatcgttaaagatca

SEQ ID NO: 208 - DNA, 32 bp, synthetic construct
  misc_feature 1..32: note = synthetic oligonucleotide
  source 1..32: mol_type = other DNA
cgacagacgcctgatctttaaccggacactct

SEQ ID NO: 209 - DNA, 25 bp, synthetic construct
  misc_feature 1..25: note = synthetic oligonucleotide
  source 1..25: mol_type = other DNA
gatcagagtgtccggttaaagatca

SEQ ID NO: 210 - DNA, 32 bp, synthetic construct
  misc_feature 1..32: note = synthetic oligonucleotide
  source 1..32: mol_type = other DNA
cgacagacgcctgatctttaacatcggcctct

SEQ ID NO: 211 - DNA, 25 bp, synthetic construct
  misc_feature 1..25: note = synthetic oligonucleotide
  source 1..25: mol_type = other DNA
gatcagaggccgatgttaaagatca

SEQ ID NO: 212 - DNA, 32 bp, synthetic construct
  misc_feature 1..32: note = synthetic oligonucleotide
  source 1..32: mol_type = other DNA
cgacagacgcctgatctttaacaagcggaggt

SEQ ID NO: 213 - DNA, 25 bp, synthetic construct
  misc_feature 1..25: note = synthetic oligonucleotide
  source 1..25: mol_type = other DNA
gatcacctccgcttgttaaagatca

SEQ ID NO: 214 - DNA, 32 bp, synthetic construct
  misc_feature 1..32: note = synthetic oligonucleotide
  source 1..32: mol_type = other DNA
cgacagacgcctgatctttaaagcacggaggt

SEQ ID NO: 215 - DNA, 25 bp, synthetic construct
  misc_feature 1..25: note = synthetic oligonucleotide
  source 1..25: mol_type = other DNA
gatcacctccgtgctttaaagatca

SEQ ID NO: 216 - DNA, 32 bp, synthetic construct
  misc_feature 1..32: note = synthetic oligonucleotide
  source 1..32: mol_type = other DNA
cgacagacgcctgatcttgtttagcacctcct

SEQ ID NO: 217 - DNA, 25 bp, synthetic construct
  misc_feature 1..25: note = synthetic oligonucleotide
  source 1..25: mol_type = other DNA
gatcaggaggtgctaaacaagatca

SEQ ID NO: 218 - DNA, 32 bp, synthetic construct
  misc_feature 1..32: note = synthetic oligonucleotide
  source 1..32: mol_type = other DNA
cgacagacgcctgatcttgttctgaaggctgt

SEQ ID NO: 219 - DNA, 25 bp, synthetic construct
  misc_feature 1..25: note = synthetic oligonucleotide
  source 1..25: mol_type = other DNA
gatcacagccttcagaacaagatca

SEQ ID NO: 220 - DNA, 32 bp, synthetic construct
  misc_feature 1..32: note = synthetic oligonucleotide
  source 1..32: mol_type = other DNA
cgacagacgcctgatcttgttatgaggacgct

SEQ ID NO: 221 - DNA, 25 bp, synthetic construct
  misc_feature 1..25: note = synthetic oligonucleotide
  source 1..25: mol_type = other DNA
gatcagcgtcctcataacaagatca

SEQ ID NO: 222 - DNA, 32 bp, synthetic construct
  misc_feature 1..32: note = synthetic oligonucleotide
  source 1..32: mol_type = other DNA
cgacagacgcctgatcttgtgtacaagcaggt

SEQ ID NO: 223 - DNA, 25 bp, synthetic construct
  misc_feature 1..25: note = synthetic oligonucleotide
  source 1..25: mol_type = other DNA
gatcacctgcttgtacacaagatca

SEQ ID NO: 224 - DNA, 32 bp, synthetic construct
  misc_feature 1..32: note = synthetic oligonucleotide
  source 1..32: mol_type = other DNA
cgacagacgcctgatcttgtggttcatacggt

SEQ ID NO: 225 - DNA, 25 bp, synthetic construct
  misc_feature 1..25: note = synthetic oligonucleotide
  source 1..25: mol_type = other DNA
gatcaccgtatgaaccacaagatca

SEQ ID NO: 226 - DNA, 32 bp, synthetic construct
  misc_feature 1..32: note = synthetic oligonucleotide
  source 1..32: mol_type = other DNA
cgacagacgcctgatcttgtggattactggct

SEQ ID NO: 227 - DNA, 25 bp, synthetic construct
  misc_feature 1..25: note = synthetic oligonucleotide
  source 1..25: mol_type = other DNA
gatcagccagtaatccacaagatca

SEQ ID NO: 228 - DNA, 32 bp, synthetic construct
  misc_feature 1..32: note = synthetic oligonucleotide
  source 1..32: mol_type = other DNA
cgacagacgcctgatcttgtgaagatgcctgt

SEQ ID NO: 229 - DNA, 25 bp, synthetic construct
  misc_feature 1..25: note = synthetic oligonucleotide
  source 1..25: mol_type = other DNA
gatcacaggcatcttcacaagatca

SEQ ID NO: 230 - DNA, 32 bp, synthetic construct
  misc_feature 1..32: note = synthetic oligonucleotide
  source 1..32: mol_type = other DNA
cgacagacgcctgatcttgtctgacctccatt

SEQ ID NO: 231 - DNA, 25 bp, synthetic construct
  misc_feature 1..25: note = synthetic oligonucleotide
  source 1..25: mol_type = other DNA
gatcaatggaggtcagacaagatca

SEQ ID NO: 232 - DNA, 32 bp, synthetic construct
  misc_feature 1..32: note = synthetic oligonucleotide
  source 1..32: mol_type = other DNA
cgacagacgcctgatcttgtctacactccgat

SEQ ID NO: 233 - DNA, 25 bp, synthetic construct
  misc_feature 1..25: note = synthetic oligonucleotide
  source 1..25: mol_type = other DNA
gatcatcggagtgtagacaagatca

SEQ ID NO: 234 - DNA, 32 bp, synthetic construct
  misc_feature 1..32: note = synthetic oligonucleotide
  source 1..32: mol_type = other DNA
cgacagacgcctgatcttgtcggagaacaagt

SEQ ID NO: 235 - DNA, 25 bp, synthetic construct
  misc_feature 1..25: note = synthetic oligonucleotide
  source 1..25: mol_type = other DNA
gatcacttgttctccgacaagatca

SEQ ID NO: 236 - DNA, 32 bp, synthetic construct
  misc_feature 1..32: note = synthetic oligonucleotide
  source 1..32: mol_type = other DNA
cgacagacgcctgatcttgtcataggcgttct

SEQ ID NO: 237 - DNA, 25 bp, synthetic construct
  misc_feature 1..25: note = synthetic oligonucleotide
  source 1..25: mol_type = other DNA
gatcagaacgcctatgacaagatca

SEQ ID NO: 238 - DNA, 32 bp, synthetic construct
  misc_feature 1..32: note = synthetic oligonucleotide
  source 1..32: mol_type = other DNA
cgacagacgcctgatcttgtcactcttcacgt

SEQ ID NO: 239 - DNA, 25 bp, synthetic construct
  misc_feature 1..25: note = synthetic oligonucleotide
  source 1..25: mol_type = other DNA
gatcacgtgaagagtgacaagatca

SEQ ID NO: 240 - DNA, 32 bp, synthetic construct
  misc_feature 1..32: note = synthetic oligonucleotide
  source 1..32: mol_type = other DNA
cgacagacgcctgatcttgtatttccgaggct

SEQ ID NO: 241 - DNA, 25 bp, synthetic construct
  misc_feature 1..25: note = synthetic oligonucleotide
  source 1..25: mol_type = other DNA
gatcagcctcggaaatacaagatca

SEQ ID NO: 242 - DNA, 32 bp, synthetic construct
  misc_feature 1..32: note = synthetic oligonucleotide
  source 1..32: mol_type = other DNA
cgacagacgcctgatcttgtatgactgtggct

SEQ ID NO: 243 - DNA, 25 bp, synthetic construct
  misc_feature 1..25: note = synthetic oligonucleotide
  source 1..25: mol_type = other DNA
gatcagccacagtcatacaagatca

SEQ ID NO: 244 - DNA, 32 bp, synthetic construct
  misc_feature 1..32: note = synthetic oligonucleotide
  source 1..32: mol_type = other DNA
cgacagacgcctgatcttgtactgcaactggt

SEQ ID NO: 245 - DNA, 25 bp, synthetic construct
  misc_feature 1..25: note = synthetic oligonucleotide
  source 1..25: mol_type = other DNA
gatcaccagttgcagtacaagatca

SEQ ID NO: 246 - DNA, 32 bp, synthetic construct
  misc_feature 1..32: note = synthetic oligonucleotide
  source 1..32: mol_type = other DNA
cgacagacgcctgatcttgtactaacacgcct

SEQ ID NO: 247 - DNA, 25 bp, synthetic construct
  misc_feature 1..25: note = synthetic oligonucleotide
  source 1..25: mol_type = other DNA
gatcaggcgtgttagtacaagatca

SEQ ID NO: 248 - DNA, 32 bp, synthetic construct
  misc_feature 1..32: note = synthetic oligonucleotide
  source 1..32: mol_type = other DNA
cgacagacgcctgatcttgtacctcctgcatt

SEQ ID NO: 249 - DNA, 25 bp, synthetic construct
  misc_feature 1..25: note = synthetic oligonucleotide
  source 1..25: mol_type = other DNA
gatcaatgcaggaggtacaagatca

SEQ ID NO: 250 - DNA, 32 bp, synthetic construct
  misc_feature 1..32: note = synthetic oligonucleotide
  source 1..32: mol_type = other DNA
cgacagacgcctgatcttggtgtacttagcgt

SEQ ID NO: 251 - DNA, 25 bp, synthetic construct
  misc_feature 1..25: note = synthetic oligonucleotide
  source 1..25: mol_type = other DNA
gatcacgctaagtacaccaagatca

SEQ ID NO: 252 - DNA, 32 bp, synthetic construct
  misc_feature 1..32: note = synthetic oligonucleotide
  source 1..32: mol_type = other DNA
cgacagacgcctgatcttggtggtcaaagtct

SEQ ID NO: 253 - DNA, 25 bp, synthetic construct
  misc_feature 1..25: note = synthetic oligonucleotide
  source 1..25: mol_type = other DNA
gatcagactttgaccaccaagatca

SEQ ID NO: 254 - DNA, 32 bp, synthetic construct
  misc_feature 1..32: note = synthetic oligonucleotide
  source 1..32: mol_type = other DNA
cgacagacgcctgatcttggtcgaacaagagt

SEQ ID NO: 255 - DNA, 25 bp, synthetic construct
  misc_feature 1..25: note = synthetic oligonucleotide
  source 1..25: mol_type = other DNA
gatcactcttgttcgaccaagatca

SEQ ID NO: 256 - DNA, 32 bp, synthetic construct
  misc_feature 1..32: note = synthetic oligonucleotide
  source 1..32: mol_type = other DNA
cgacagacgcctgatcttggtacaatagcggt

SEQ ID NO: 257 - DNA, 25 bp, synthetic construct
  misc_feature 1..25: note = synthetic oligonucleotide
  source 1..25: mol_type = other DNA
gatcaccgctattgtaccaagatca

SEQ ID NO: 258 - DNA, 32 bp, synthetic construct
  misc_feature 1..32: note = synthetic oligonucleotide
  source 1..32: mol_type = other DNA
cgacagacgcctgatcttggcttctaatcggt

SEQ ID NO: 259 - DNA, 25 bp, synthetic construct
  misc_feature 1..25: note = synthetic oligonucleotide
  source 1..25: mol_type = other DNA
gatcaccgattagaagccaagatca

SEQ ID NO: 260 - DNA, 32 bp, synthetic construct
  misc_feature 1..32: note = synthetic oligonucleotide
  source 1..32: mol_type = other DNA
cgacagacgcctgatcttggcttaccaactgt

SEQ ID NO: 261 - DNA, 25 bp, synthetic construct
  misc_feature 1..25: note = synthetic oligonucleotide
  source 1..25: mol_type = other DNA
gatcacagttggtaagccaagatca

SEQ ID NO: 262 - DNA, 32 bp, synthetic construct
  misc_feature 1..32: note = synthetic oligonucleotide
  source 1..32: mol_type = other DNA
cgacagacgcctgatcttggctattacgtggt

SEQ ID NO: 263 - DNA, 25 bp, synthetic construct
  misc_feature 1..25: note = synthetic oligonucleotide
  source 1..25: mol_type = other DNA
gatcaccacgtaatagccaagatca

SEQ ID NO: 264 - DNA, 32 bp, synthetic construct
  misc_feature 1..32: note = synthetic oligonucleotide
  source 1..32: mol_type = other DNA
cgacagacgcctgatcttggcaaaccactagt

SEQ ID NO: 265 - DNA, 25 bp, synthetic construct
  misc_feature 1..25: note = synthetic oligonucleotide
  source 1..25: mol_type = other DNA
gatcactagtggtttgccaagatca

SEQ ID NO: 266 - DNA, 32 bp, synthetic construct
  misc_feature 1..32: note = synthetic oligonucleotide
  source 1..32: mol_type = other DNA
cgacagacgcctgatcttggatagccgaagat

SEQ ID NO: 267 - DNA, 25 bp, synthetic construct
  misc_feature 1..25: note = synthetic oligonucleotide
  source 1..25: mol_type = other DNA
gatcatcttcggctatccaagatca

SEQ ID NO: 268 - DNA, 32 bp, synthetic construct
  misc_feature 1..32: note = synthetic oligonucleotide
  source 1..32: mol_type = other DNA
cgacagacgcctgatcttggagatcaaacggt

SEQ ID NO: 269 - DNA, 25 bp, synthetic construct
  misc_feature 1..25: note = synthetic oligonucleotide
  source 1..25: mol_type = other DNA
gatcaccgtttgatctccaagatca

SEQ ID NO: 270 - DNA, 32 bp, synthetic construct
  misc_feature 1..32: note = synthetic oligonucleotide
  source 1..32: mol_type = other DNA
cgacagacgcctgatcttggagagcacaatgt

SEQ ID NO: 271 - DNA, 25 bp, synthetic construct
  misc_feature 1..25: note = synthetic oligonucleotide
  source 1..25: mol_type = other DNA
gatcacattgtgctctccaagatca

SEQ ID NO: 272 - DNA, 32 bp, synthetic construct
  misc_feature 1..32: note = synthetic oligonucleotide
  source 1..32: mol_type = other DNA
cgacagacgcctgatcttggagagaaccgatt

SEQ ID NO: 273 - DNA, 25 bp, synthetic construct
  misc_feature 1..25: note = synthetic oligonucleotide
  source 1..25: mol_type = other DNA
gatcaatcggttctctccaagatca

SEQ ID NO: 274 - DNA, 32 bp, synthetic construct
  misc_feature 1..32: note = synthetic oligonucleotide
  source 1..32: mol_type = other DNA
cgacagacgcctgatcttgcttaggaatcggt

SEQ ID NO: 275 - DNA, 25 bp, synthetic construct
  misc_feature 1..25: note = synthetic oligonucleotide
  source 1..25: mol_type = other DNA
gatcaccgattcctaagcaagatca

SEQ ID NO: 276 - DNA, 32 bp, synthetic construct
  misc_feature 1..32: note = synthetic oligonucleotide
  source 1..32: mol_type = other DNA
cgacagacgcctgatcttgcttaccactgact

SEQ ID NO: 277 - DNA, 25 bp, synthetic construct
  misc_feature 1..25: note = synthetic oligonucleotide
  source 1..25: mol_type = other DNA
gatcagtcagtggtaagcaagatca

SEQ ID NO: 278 - DNA, 32 bp, synthetic construct
  misc_feature 1..32: note = synthetic oligonucleotide
  source 1..32: mol_type = other DNA
cgacagacgcctgatcttgctcaaagctacct

SEQ ID NO: 279 - DNA, 25 bp, synthetic construct
  misc_feature 1..25: note = synthetic oligonucleotide
  source 1..25: mol_type = other DNA
gatcaggtagctttgagcaagatca

SEQ ID NO: 280 - DNA, 32 bp, synthetic construct
  misc_feature 1..32: note = synthetic oligonucleotide
  source 1..32: mol_type = other DNA
cgacagacgcctgatcttgcgatagtggttct

SEQ ID NO: 281 - DNA, 25 bp, synthetic construct
  misc_feature 1..25: note = synthetic oligonucleotide
  source 1..25: mol_type = other DNA
gatcagaaccactatcgcaagatca

SEQ ID NO: 282 - DNA, 32 bp, synthetic construct
  misc_feature 1..32: note = synthetic oligonucleotide
  source 1..32: mol_type = other DNA
cgacagacgcctgatcttgcgaagtagagact

SEQ ID NO: 283 - DNA, 25 bp, synthetic construct
  misc_feature 1..25: note = synthetic oligonucleotide
  source 1..25: mol_type = other DNA
gatcagtctctacttcgcaagatca

SEQ ID NO: 284 - DNA, 32 bp, synthetic construct
  misc_feature 1..32: note = synthetic oligonucleotide
  source 1..32: mol_type = other DNA
cgacagacgcctgatcttgcctaaacgatcct

SEQ ID NO: 285 - DNA, 25 bp, synthetic construct
  misc_feature 1..25: note = synthetic oligonucleotide
  source 1..25: mol_type = other DNA
gatcaggatcgtttaggcaagatca

SEQ ID NO: 286 - DNA, 32 bp, synthetic construct
  misc_feature 1..32: note = synthetic oligonucleotide
  source 1..32: mol_type = other DNA
cgacagacgcctgatcttgccaacttctctgt

SEQ ID NO: 287 - DNA, 25 bp, synthetic construct
  misc_feature 1..25: note = synthetic oligonucleotide
  source 1..25: mol_type = other DNA
gatcacagagaagttggcaagatca

SEQ ID NO: 288 - DNA, 32 bp, synthetic construct
  misc_feature 1..32: note = synthetic oligonucleotide
  source 1..32: mol_type = other DNA
cgacagacgcctgatcttgccaactataccgt

SEQ ID NO: 289 - DNA, 25 bp, synthetic construct
  misc_feature 1..25: note = synthetic oligonucleotide
  source 1..25: mol_type = other DNA
gatcacggtatagttggcaagatca

SEQ ID NO: 290 - DNA, 32 bp, synthetic construct
  misc_feature 1..32: note = synthetic oligonucleotide
  source 1..32: mol_type = other DNA
cgacagacgcctgatcttgcatcttcactggt

SEQ ID NO: 291 - DNA, 25 bp, synthetic construct
  misc_feature 1..25: note = synthetic oligonucleotide
  source 1..25: mol_type = other DNA
gatcaccagtgaagatgcaagatca

SEQ ID NO: 292 - DNA, 32 bp, synthetic construct
  misc_feature 1..32: note = synthetic oligonucleotide
  source 1..32: mol_type = other DNA
cgacagacgcctgatcttgcatatccttccgt

SEQ ID NO: 293 - DNA, 25 bp, synthetic construct
  misc_feature 1..25: note = synthetic oligonucleotide
  source 1..25: mol_type = other DNA
gatcacggaaggatatgcaagatca

SEQ ID NO: 294 - DNA, 32 bp, synthetic construct
  misc_feature 1..32: note = synthetic oligonucleotide
  source 1..32: mol_type = other DNA
cgacagacgcctgatcttgcaatcctacgtct

SEQ ID NO: 295 - DNA, 25 bp, synthetic construct
  misc_feature 1..25: note = synthetic oligonucleotide
  source 1..25: mol_type = other DNA
gatcagacgtaggattgcaagatca

SEQ ID NO: 296 - DNA, 32 bp, synthetic construct
  misc_feature 1..32: note = synthetic oligonucleotide
  source 1..32: mol_type = other DNA
cgacagacgcctgatcttgcaatagacgacct

SEQ ID NO: 297 - DNA, 25 bp, synthetic construct
  misc_feature 1..25: note = synthetic oligonucleotide
  source 1..25: mol_type = other DNA
gatcaggtcgtctattgcaagatca

SEQ ID NO: 298 - DNA, 32 bp, synthetic construct
  misc_feature 1..32: note = synthetic oligonucleotide
  source 1..32: mol_type = other DNA
cgacagacgcctgatcttgatttacctcgcct

SEQ ID NO: 299 - DNA, 25 bp, synthetic construct
  misc_feature 1..25: note = synthetic oligonucleotide
  source 1..25: mol_type = other DNA
gatcaggcgaggtaaatcaagatca

SEQ ID NO: 300 - DNA, 32 bp, synthetic construct
  misc_feature 1..32: note = synthetic oligonucleotide
  source 1..32: mol_type = other DNA
cgacagacgcctgatcttgattagttccgcct

SEQ ID NO: 301 - DNA, 25 bp, synthetic construct
  misc_feature 1..25: note = synthetic oligonucleotide
  source 1..25: mol_type = other DNA
gatcaggcggaactaatcaagatca

SEQ ID NO: 302 - DNA, 32 bp, synthetic construct
  misc_feature 1..32: note = synthetic oligonucleotide
  source 1..32: mol_type = other DNA
cgacagacgcctgatcttgattactccgtgct

SEQ ID NO: 303 - DNA, 25 bp, synthetic construct
  misc_feature 1..25: note = synthetic oligonucleotide
  source 1..25: mol_type = other DNA
gatcagcacggagtaatcaagatca

SEQ ID NO: 304 - DNA, 32 bp, synthetic construct
  misc_feature 1..32: note = synthetic oligonucleotide
  source 1..32: mol_type = other DNA
cgacagacgcctgatcttgatggttcactggt

SEQ ID NO: 305 - DNA, 25 bp, synthetic construct
  misc_feature 1..25: note = synthetic oligonucleotide
  source 1..25: mol_type = other DNA
gatcaccagtgaaccatcaagatca

SEQ ID NO: 306 - DNA, 32 bp, synthetic construct
  misc_feature 1..32: note = synthetic oligonucleotide
  source 1..32: mol_type = other DNA
cgacagacgcctgatcttgatgagaagacgct

SEQ ID NO: 307 - DNA, 25 bp, synthetic construct
  misc_feature 1..25: note = synthetic oligonucleotide
  source 1..25: mol_type = other DNA
gatcagcgtcttctcatcaagatca

SEQ ID NO: 308 - DNA, 32 bp, synthetic construct
  misc_feature 1..32: note = synthetic oligonucleotide
  source 1..32: mol_type = other DNA
cgacagacgcctgatcttgatccgtccaaagt

SEQ ID NO: 309 - DNA, 25 bp, synthetic construct
  misc_feature 1..25: note = synthetic oligonucleotide
  source 1..25: mol_type = other DNA
gatcactttggacggatcaagatca

SEQ ID NO: 310 - DNA, 32 bp, synthetic construct
  misc_feature 1..32: note = synthetic oligonucleotide
  source 1..32: mol_type = other DNA
cgacagacgcctgatcttgatccacaacgagt

SEQ ID NO: 311 - DNA, 25 bp, synthetic construct
  misc_feature 1..25: note = synthetic oligonucleotide
  source 1..25: mol_type = other DNA
gatcactcgttgtggatcaagatca

SEQ ID NO: 312 - DNA, 32 bp, synthetic construct
  misc_feature 1..32: note = synthetic oligonucleotide
  source 1..32: mol_type = other DNA
cgacagacgcctgatcttgatcaacacctcgt

SEQ ID NO: 313 - DNA, 25 bp, synthetic construct
  misc_feature 1..25: note = synthetic oligonucleotide
  source 1..25: mol_type = other DNA
gatcacgaggtgttgatcaagatca

SEQ ID NO: 314 - DNA, 32 bp, synthetic construct
  misc_feature 1..32: note = synthetic oligonucleotide
  source 1..32: mol_type = other DNA
cgacagacgcctgatcttgatatcctgtgcgt

SEQ ID NO: 315 - DNA, 25 bp, synthetic construct
  misc_feature 1..25: note = synthetic oligonucleotide
  source 1..25: mol_type = other DNA
gatcacgcacaggatatcaagatca

SEQ ID NO: 316 - DNA, 32 bp, synthetic construct
  misc_feature 1..32: note = synthetic oligonucleotide
  source 1..32: mol_type = other DNA
cgacagacgcctgatcttgatactcaacggct

SEQ ID NO: 317 - DNA, 25 bp, synthetic construct
  misc_feature 1..25: note = synthetic oligonucleotide
  source 1..25: mol_type = other DNA
gatcagccgttgagtatcaagatca

SEQ ID NO: 318 - DNA, 32 bp, synthetic construct
  misc_feature 1..32: note = synthetic oligonucleotide
  source 1..32: mol_type = other DNA
cgacagacgcctgatcttgagtccagaaggtt

SEQ ID NO: 319 - DNA, 25 bp, synthetic construct
  misc_feature 1..25: note = synthetic oligonucleotide
  source 1..25: mol_type = other DNA
gatcaaccttctggactcaagatca

SEQ ID NO: 320 - DNA, 32 bp, synthetic construct
  misc_feature 1..32: note = synthetic oligonucleotide
  source 1..32: mol_type = other DNA
cgacagacgcctgatcttgaggttacaaggct

SEQ ID NO: 321 - DNA, 25 bp, synthetic construct
  misc_feature 1..25: note = synthetic oligonucleotide
  source 1..25: mol_type = other DNA
gatcagccttgtaacctcaagatca

SEQ ID NO: 322 - DNA, 32 bp, synthetic construct
  misc_feature 1..32: note = synthetic oligonucleotide
  source 1..32: mol_type = other DNA
cgacagacgcctgatcttgaggtcttcggatt

SEQ ID NO: 323 - DNA, 25 bp, synthetic construct
  misc_feature 1..25: note = synthetic oligonucleotide
  source 1..25: mol_type = other DNA
gatcaatccgaagacctcaagatca

SEQ ID NO: 324 - DNA, 32 bp, synthetic construct
  misc_feature 1..32: note = synthetic oligonucleotide
  source 1..32: mol_type = other DNA
cgacagacgcctgatcttgagcaactgaaggt

SEQ ID NO: 325 - DNA, 25 bp, synthetic construct
  misc_feature 1..25: note = synthetic oligonucleotide
  source 1..25: mol_type = other DNA
gatcaccttcagttgctcaagatca

SEQ ID NO: 326 - DNA, 32 bp, synthetic construct
  misc_feature 1..32: note = synthetic oligonucleotide
  source 1..32: mol_type = other DNA
cgacagacgcctgatcttgagagttgccatgt

SEQ ID NO: 327 - DNA, 25 bp, synthetic construct
  misc_feature 1..25: note = synthetic oligonucleotide
  source 1..25: mol_type = other DNA
gatcacatggcaactctcaagatca

SEQ ID NO: 328 - DNA, 32 bp, synthetic construct
  misc_feature 1..32: note = synthetic oligonucleotide
  source 1..32: mol_type = other DNA
cgacagacgcctgatcttgagacaaccactgt

SEQ ID NO: 329 - DNA, 25 bp, synthetic construct
  misc_feature 1..25: note = synthetic oligonucleotide
  source 1..25: mol_type = other DNA
gatcacagtggttgtctcaagatca

SEQ ID NO: 330 - DNA, 32 bp, synthetic construct
  misc_feature 1..32: note = synthetic oligonucleotide
  source 1..32: mol_type = other DNA
cgacagacgcctgatcttgactctctacgctt

SEQ ID NO: 331 - DNA, 25 bp, synthetic construct
  misc_feature 1..25: note = synthetic oligonucleotide
  source 1..25: mol_type = other DNA
gatcaagcgtagagagtcaagatca

SEQ ID NO: 332 - DNA, 32 bp, synthetic construct
  misc_feature 1..32: note = synthetic oligonucleotide
  source 1..32: mol_type = other DNA
cgacagacgcctgatcttgactactcaccgtt

SEQ ID NO: 333 - DNA, 25 bp, synthetic construct
  misc_feature 1..25: note = synthetic oligonucleotide
  source 1..25: mol_type = other DNA
gatcaacggtgagtagtcaagatca

SEQ ID NO: 334 - DNA, 32 bp, synthetic construct
  misc_feature 1..32: note = synthetic oligonucleotide
  source 1..32: mol_type = other DNA
cgacagacgcctgatcttgacgaaactggagt

SEQ ID NO: 335 - DNA, 25 bp, synthetic construct
  misc_feature 1..25: note = synthetic oligonucleotide
  source 1..25: mol_type = other DNA
gatcactccagtttcgtcaagatca

SEQ ID NO: 336 - DNA, 32 bp, synthetic construct
  misc_feature 1..32: note = synthetic oligonucleotide
  source 1..32: mol_type = other DNA
cgacagacgcctgatcttgaccttcaacctgt

SEQ ID NO: 337 - DNA, 25 bp, synthetic construct
  misc_feature 1..25: note = synthetic oligonucleotide
  source 1..25: mol_type = other DNA
gatcacaggttgaaggtcaagatca

SEQ ID NO: 338 - DNA, 32 bp, synthetic construct
  misc_feature 1..32: note = synthetic oligonucleotide
  source 1..32: mol_type = other DNA
cgacagacgcctgatcttgacaagtcacacct

SEQ ID NO: 339 - DNA, 25 bp, synthetic construct
  misc_feature 1..25: note = synthetic oligonucleotide
  source 1..25: mol_type = other DNA
gatcaggtgtgacttgtcaagatca

SEQ ID NO: 340 - DNA, 32 bp, synthetic construct
  misc_feature 1..32: note = synthetic oligonucleotide
  source 1..32: mol_type = other DNA
cgacagacgcctgatcttgaatctctgccact

SEQ ID NO: 341 - DNA, 25 bp, synthetic construct
  misc_feature 1..25: note = synthetic oligonucleotide
  source 1..25: mol_type = other DNA
gatcagtggcagagattcaagatca

SEQ ID NO: 342 - DNA, 32 bp, synthetic construct
  misc_feature 1..32: note = synthetic oligonucleotide
  source 1..32: mol_type = other DNA
cgacagacgcctgatcttgaaggactacggtt

SEQ ID NO: 343 - DNA, 25 bp, synthetic construct
  misc_feature 1..25: note = synthetic oligonucleotide
  source 1..25: mol_type = other DNA
gatcaaccgtagtccttcaagatca

SEQ ID NO: 344 - DNA, 32 bp, synthetic construct
  misc_feature 1..32: note = synthetic oligonucleotide
  source 1..32: mol_type = other DNA
cgacagacgcctgatcttgaagcaacctgagt

SEQ ID NO: 345 - DNA, 25 bp, synthetic construct
  misc_feature 1..25: note = synthetic oligonucleotide
  source 1..25: mol_type = other DNA
gatcactcaggttgcttcaagatca

SEQ ID NO: 346 - DNA, 32 bp, synthetic construct
  misc_feature 1..32: note = synthetic oligonucleotide
  source 1..32: mol_type = other DNA
cgacagacgcctgatcttgaacaccttctggt

SEQ ID NO: 347 - DNA, 25 bp, synthetic construct
  misc_feature 1..25: note = synthetic oligonucleotide
  source 1..25: mol_type = other DNA
gatcaccagaaggtgttcaagatca

SEQ ID NO: 348 - DNA, 32 bp, synthetic construct
  misc_feature 1..32: note = synthetic oligonucleotide
  source 1..32: mol_type = other DNA
cgacagacgcctgatcttgaaatactccgcct

SEQ ID NO: 349 - DNA, 25 bp, synthetic construct
  misc_feature 1..25: note = synthetic oligonucleotide
  source 1..25: mol_type = other DNA
gatcaggcggagtatttcaagatca

SEQ ID NO: 350 - DNA, 32 bp, synthetic construct
  misc_feature 1..32: note = synthetic oligonucleotide
  source 1..32: mol_type = other DNA
cgacagacgcctgatcttctttgataccgcct

SEQ ID NO: 351 - DNA, 25 bp, synthetic construct
  misc_feature 1..25: note = synthetic oligonucleotide
  source 1..25: mol_type = other DNA
gatcaggcggtatcaaagaagatca

SEQ ID NO: 352 - DNA, 32 bp, synthetic construct
  misc_feature 1..32: note = synthetic oligonucleotide
  source 1..32: mol_type = other DNA
cgacagacgcctgatcttctttccagcagtct

SEQ ID NO: 353 - DNA, 25 bp, synthetic construct
  misc_feature 1..25: note = synthetic oligonucleotide
  source 1..25: mol_type = other DNA
gatcagactgctggaaagaagatca

SEQ ID NO: 354 - DNA, 32 bp, synthetic construct
  misc_feature 1..32: note = synthetic oligonucleotide
  source 1..32: mol_type = other DNA
cgacagacgcctgatcttctttaggatgcggt

SEQ ID NO: 355 - DNA, 25 bp, synthetic construct
  misc_feature 1..25: note = synthetic oligonucleotide
  source 1..25: mol_type = other DNA
gatcaccgcatcctaaagaagatca

SEQ ID NO: 356 - DNA, 32 bp, synthetic construct
  misc_feature 1..32: note = synthetic oligonucleotide
  source 1..32: mol_type = other DNA
cgacagacgcctgatcttcttaggaaacgcct

SEQ ID NO: 357 - DNA, 25 bp, synthetic construct
  misc_feature 1..25: note = synthetic oligonucleotide
  source 1..25: mol_type = other DNA
gatcaggcgtttcctaagaagatca

SEQ ID NO: 358 - DNA, 32 bp, synthetic construct
  misc_feature 1..32: note = synthetic oligonucleotide
  source 1..32: mol_type = other DNA
cgacagacgcctgatcttcttaactcgtgcct

SEQ ID NO: 359 - DNA, 25 bp, synthetic construct
  misc_feature 1..25: note = synthetic oligonucleotide
  source 1..25: mol_type = other DNA
gatcaggcacgagttaagaagatca

SEQ ID NO: 360 - DNA, 32 bp, synthetic construct
  misc_feature 1..32: note = synthetic oligonucleotide
  source 1..32: mol_type = other DNA
cgacagacgcctgatcttctgtcctccgaatt

SEQ ID NO: 361 - DNA, 25 bp, synthetic construct
  misc_feature 1..25: note = synthetic oligonucleotide
  source 1..25: mol_type = other DNA
gatcaattcggaggacagaagatca

SEQ ID NO: 362 - DNA, 32 bp, synthetic construct
  misc_feature 1..32: note = synthetic oligonucleotide
  source 1..32: mol_type = other DNA
cgacagacgcctgatcttctggaatgaggctt

SEQ ID NO: 363 - DNA, 25 bp, synthetic construct
  misc_feature 1..25: note = synthetic oligonucleotide
  source 1..25: mol_type = other DNA
gatcaagcctcattccagaagatca

SEQ ID NO: 364 - DNA, 32 bp, synthetic construct
  misc_feature 1..32: note = synthetic oligonucleotide
  source 1..32: mol_type = other DNA
cgacagacgcctgatcttctgccaaagactct

SEQ ID NO: 365 - DNA, 25 bp, synthetic construct
  misc_feature 1..25: note = synthetic oligonucleotide
  source 1..25: mol_type = other DNA
gatcagagtctttggcagaagatca

SEQ ID NO: 366 - DNA, 32 bp, synthetic construct
  misc_feature 1..32: note = synthetic oligonucleotide
  source 1..32: mol_type = other DNA
cgacagacgcctgatcttctctgaaactgcct

SEQ ID NO: 367 - DNA, 25 bp, synthetic construct
  misc_feature 1..25: note = synthetic oligonucleotide
  source 1..25: mol_type = other DNA
gatcaggcagtttcagagaagatca

SEQ ID NO: 368 - DNA, 32 bp, synthetic construct
  misc_feature 1..32: note = synthetic oligonucleotide
  source 1..32: mol_type = other DNA
cgacagacgcctgatcttctcgttggaagtct

SEQ ID NO: 369 - DNA, 25 bp, synthetic construct
  misc_feature 1..25: note = synthetic oligonucleotide
  source 1..25: mol_type = other DNA
gatcagacttccaacgagaagatca

SEQ ID NO: 370 - DNA, 32 bp, synthetic construct
  misc_feature 1..32: note = synthetic oligonucleotide
  source 1..32: mol_type = other DNA
cgacagacgcctgatcttctccaggttcacat

SEQ ID NO: 371 - DNA, 25 bp, synthetic construct
  misc_feature 1..25: note = synthetic oligonucleotide
  source 1..25: mol_type = other DNA
gatcatgtgaacctggagaagatca

SEQ ID NO: 372 - DNA, 32 bp, synthetic construct
  misc_feature 1..32: note = synthetic oligonucleotide
  source 1..32: mol_type = other DNA
cgacagacgcctgatcttctccaaggtgtctt

SEQ ID NO: 373 - DNA, 25 bp, synthetic construct
  misc_feature 1..25: note = synthetic oligonucleotide
  source 1..25: mol_type = other DNA
gatcaagacaccttggagaagatca

SEQ ID NO: 374 - DNA, 32 bp, synthetic construct
  misc_feature 1..32: note = synthetic oligonucleotide
  source 1..32: mol_type = other DNA
cgacagacgcctgatcttctcaaggacaacgt

SEQ ID NO: 375 - DNA, 25 bp, synthetic construct
  misc_feature 1..25: note = synthetic oligonucleotide
  source 1..25: mol_type = other DNA
gatcacgttgtccttgagaagatca

SEQ ID NO: 376 - DNA, 32 bp, synthetic construct
  misc_feature 1..32: note = synthetic oligonucleotide
  source 1..32: mol_type = other DNA
cgacagacgcctgatcttctcaacatggctct

SEQ ID NO: 377 - DNA, 25 bp, synthetic construct
  misc_feature 1..25: note = synthetic oligonucleotide
  source 1..25: mol_type = other DNA
gatcagagccatgttgagaagatca

SEQ ID NO: 378 - DNA, 32 bp, synthetic construct
  misc_feature 1..32: note = synthetic oligonucleotide
  source 1..32: mol_type = other DNA
cgacagacgcctgatcttctatcacaaggcgt

SEQ ID NO: 379 - DNA, 25 bp, synthetic construct
  misc_feature 1..25: note = synthetic oligonucleotide
  source 1..25: mol_type = other DNA
gatcacgccttgtgatagaagatca

SEQ ID NO: 380 - DNA, 32 bp, synthetic construct
  misc_feature 1..32: note = synthetic oligonucleotide
  source 1..32: mol_type = other DNA
cgacagacgcctgatcttctaggtatgcggtt

SEQ ID NO: 381 - DNA, 25 bp, synthetic construct
  misc_feature 1..25: note = synthetic oligonucleotide
  source 1..25: mol_type = other DNA
gatcaaccgcatacctagaagatca

SEQ ID NO: 382 - DNA, 32 bp, synthetic construct
  misc_feature 1..32: note = synthetic oligonucleotide
  source 1..32: mol_type = other DNA
cgacagacgcctgatcttctagcaacggaact

SEQ ID NO: 383 - DNA, 25 bp, synthetic construct
  misc_feature 1..25: note = synthetic oligonucleotide
  source 1..25: mol_type = other DNA
gatcagttccgttgctagaagatca

SEQ ID NO: 384 - DNA, 32 bp, synthetic construct
  misc_feature 1..32: note = synthetic oligonucleotide
  source 1..32: mol_type = other DNA
cgacagacgcctgatcttctaacggtggtctt

SEQ ID NO: 385 - DNA, 25 bp, synthetic construct
  misc_feature 1..25: note = synthetic oligonucleotide
  source 1..25: mol_type = other DNA
gatcaagaccaccgttagaagatca

SEQ ID NO: 386 - DNA, 32 bp, synthetic construct
  misc_feature 1..32: note = synthetic oligonucleotide
  source 1..32: mol_type = other DNA
cgacagacgcctgatcttctaaagcgtccact

SEQ ID NO: 387 - DNA, 25 bp, synthetic construct
  misc_feature 1..25: note = synthetic oligonucleotide
  source 1..25: mol_type = other DNA
gatcagtggacgctttagaagatca

SEQ ID NO: 388 - DNA, 32 bp, synthetic construct
  misc_feature 1..32: note = synthetic oligonucleotide
  source 1..32: mol_type = other DNA
cgacagacgcctgatcttctaaagaccgcact

SEQ ID NO: 389 - DNA, 25 bp, synthetic construct
  misc_feature 1..25: note = synthetic oligonucleotide
  source 1..25: mol_type = other DNA
gatcagtgcggtctttagaagatca

SEQ ID NO: 390 - DNA, 32 bp, synthetic construct
  misc_feature 1..32: note = synthetic oligonucleotide
  source 1..32: mol_type = other DNA
cgacagacgcctgatcttcgtaggagaagctt

SEQ ID NO: 391 - DNA, 25 bp, synthetic construct
  misc_feature 1..25: note = synthetic oligonucleotide
  source 1..25: mol_type = other DNA
gatcaagcttctcctacgaagatca

SEQ ID NO: 392 - DNA, 32 bp, synthetic construct
  misc_feature 1..32: note = synthetic oligonucleotide
  source 1..32: mol_type = other DNA
cgacagacgcctgatcttcgtacctccaagat

SEQ ID NO: 393 - DNA, 25 bp, synthetic construct
  misc_feature 1..25: note = synthetic oligonucleotide
  source 1..25: mol_type = other DNA
gatcatcttggaggtacgaagatca

SEQ ID NO: 394 - DNA, 32 bp, synthetic construct
  misc_feature 1..32: note = synthetic oligonucleotide
  source 1..32: mol_type = other DNA
cgacagacgcctgatcttcgtaatacgctcct

SEQ ID NO: 395 - DNA, 25 bp, synthetic construct
  misc_feature 1..25: note = synthetic oligonucleotide
  source 1..25: mol_type = other DNA
gatcaggagcgtattacgaagatca

SEQ ID NO: 396 - DNA, 32 bp, synthetic construct
  misc_feature 1..32: note = synthetic oligonucleotide
  source 1..32: mol_type = other DNA
cgacagacgcctgatcttcggttagattggct

SEQ ID NO: 397 - DNA, 25 bp, synthetic construct
  misc_feature 1..25: note = synthetic oligonucleotide
  source 1..25: mol_type = other DNA
gatcagccaatctaaccgaagatca

SEQ ID NO: 398 - DNA, 32 bp, synthetic construct
  misc_feature 1..32: note = synthetic oligonucleotide
  source 1..32: mol_type = other DNA
cgacagacgcctgatcttcggtaccaacaact

SEQ ID NO: 399 - DNA, 25 bp, synthetic construct
  misc_feature 1..25: note = synthetic oligonucleotide
  source 1..25: mol_type = other DNA
gatcagttgttggtaccgaagatca

SEQ ID NO: 400 - DNA, 32 bp, synthetic construct
  misc_feature 1..32: note = synthetic oligonucleotide
  source 1..32: mol_type = other DNA
cgacagacgcctgatcttcggatagagagcat

SEQ ID NO: 401 - DNA, 25 bp, synthetic construct
  misc_feature 1..25: note = synthetic oligonucleotide
  source 1..25: mol_type = other DNA
gatcatgctctctatccgaagatca

SEQ ID NO: 402 - DNA, 32 bp, synthetic construct
  misc_feature 1..32: note = synthetic oligonucleotide
  source 1..32: mol_type = other DNA
cgacagacgcctgatcttcggaaagacgtagt

SEQ ID NO: 403 - DNA, 25 bp, synthetic construct
  misc_feature 1..25: note = synthetic oligonucleotide
  source 1..25: mol_type = other DNA
gatcactacgtctttccgaagatca

SEQ ID NO: 404 - DNA, 32 bp, synthetic construct
  misc_feature 1..32: note = synthetic oligonucleotide
  source 1..32: mol_type = other DNA
cgacagacgcctgatcttcgcaagaggtaagt

SEQ ID NO: 405 - DNA, 25 bp, synthetic construct
  misc_feature 1..25: note = synthetic oligonucleotide
  source 1..25: mol_type = other DNA
gatcacttacctcttgcgaagatca

SEQ ID NO: 406 - DNA, 32 bp, synthetic construct
  misc_feature 1..32: note = synthetic oligonucleotide
  source 1..32: mol_type = other DNA
cgacagacgcctgatcttcgagatggtgttct

SEQ ID NO: 407 - DNA, 25 bp, synthetic construct
  misc_feature 1..25: note = synthetic oligonucleotide
  source 1..25: mol_type = other DNA
gatcagaacaccatctcgaagatca

SEQ ID NO: 408 - DNA, 32 bp, synthetic construct
  misc_feature 1..32: note = synthetic oligonucleotide
  source 1..32: mol_type = other DNA
cgacagacgcctgatcttcgaagaagatgcct

SEQ ID NO: 409 - DNA, 25 bp, synthetic construct
  misc_feature 1..25: note = synthetic oligonucleotide
  source 1..25: mol_type = other DNA
gatcaggcatcttcttcgaagatca

SEQ ID NO: 410 - DNA, 32 bp, synthetic construct
  misc_feature 1..32: note = synthetic oligonucleotide
  source 1..32: mol_type = other DNA
cgacagacgcctgatcttcgaactacacagct

SEQ ID NO: 411 - DNA, 25 bp, synthetic construct
  misc_feature 1..25: note = synthetic oligonucleotide
  source 1..25: mol_type = other DNA
gatcagctgtgtagttcgaagatca

SEQ ID NO: 412 - DNA, 32 bp, synthetic construct
  misc_feature 1..32: note = synthetic oligonucleotide
  source 1..32: mol_type = other DNA
cgacagacgcctgatcttccttacggactcat

SEQ ID NO: 413 - DNA, 25 bp, synthetic construct
  misc_feature 1..25: note = synthetic oligonucleotide
  source 1..25: mol_type = other DNA
gatcatgagtccgtaaggaagatca

SEQ ID NO: 414 - DNA, 32 bp, synthetic construct
  misc_feature 1..32: note = synthetic oligonucleotide
  source 1..32: mol_type = other DNA
cgacagacgcctgatcttcctgttggtgaagt

SEQ ID NO: 415 - DNA, 25 bp, synthetic construct
  misc_feature 1..25: note = synthetic oligonucleotide
  source 1..25: mol_type = other DNA
gatcacttcaccaacaggaagatca

SEQ ID NO: 416 - DNA, 32 bp, synthetic construct
  misc_feature 1..32: note = synthetic oligonucleotide
  source 1..32: mol_type = other DNA
cgacagacgcctgatcttcctggatggaagtt

SEQ ID NO: 417 - DNA, 25 bp, synthetic construct
  misc_feature 1..25: note = synthetic oligonucleotide
  source 1..25: mol_type = other DNA
gatcaacttccatccaggaagatca

SEQ ID NO: 418 - DNA, 32 bp, synthetic construct
  misc_feature 1..32: note = synthetic oligonucleotide
  source 1..32: mol_type = other DNA
cgacagacgcctgatcttcctcaagttcgtct

SEQ ID NO: 419 - DNA, 25 bp, synthetic construct
  misc_feature 1..25: note = synthetic oligonucleotide
  source 1..25: mol_type = other DNA
gatcagacgaacttgaggaagatca

SEQ ID NO: 420 - DNA, 32 bp, synthetic construct
  misc_feature 1..32: note = synthetic oligonucleotide
  source 1..32: mol_type = other DNA
cgacagacgcctgatcttcctaccggactttt

SEQ ID NO: 421 - DNA, 25 bp, synthetic construct
  misc_feature 1..25: note = synthetic oligonucleotide
  source 1..25: mol_type = other DNA
gatcaaaagtccggtaggaagatca

SEQ ID NO: 422 - DNA, 32 bp, synthetic construct
  misc_feature 1..32: note = synthetic oligonucleotide
  source 1..32: mol_type = other DNA
cgacagacgcctgatcttccgtgaaaggaagt

SEQ ID NO: 423 - DNA, 25 bp, synthetic construct
  misc_feature 1..25: note = synthetic oligonucleotide
  source 1..25: mol_type = other DNA
gatcacttcctttcacggaagatca

SEQ ID NO: 424 - DNA, 32 bp, synthetic construct
  misc_feature 1..32: note = synthetic oligonucleotide
  source 1..32: mol_type = other DNA
cgacagacgcctgatcttccggatatgttgct

SEQ ID NO: 425 - DNA, 25 bp, synthetic construct
  misc_feature 1..25: note = synthetic oligonucleotide
  source 1..25: mol_type = other DNA
gatcagcaacatatccggaagatca

SEQ ID NO: 426 - DNA, 32 bp, synthetic construct
  misc_feature 1..32: note = synthetic oligonucleotide
  source 1..32: mol_type = other DNA
cgacagacgcctgatcttccgctaaatgtcct

SEQ ID NO: 427 - DNA, 25 bp, synthetic construct
  misc_feature 1..25: note = synthetic oligonucleotide
  source 1..25: mol_type = other DNA
gatcaggacatttagcggaagatca

SEQ ID NO: 428 - DNA, 32 bp, synthetic construct
  misc_feature 1..32: note = synthetic oligonucleotide
  source 1..32: mol_type = other DNA
cgacagacgcctgatcttccgaaactatgcct

SEQ ID NO: 429 - DNA, 25 bp, synthetic construct
  misc_feature 1..25: note = synthetic oligonucleotide
  source 1..25: mol_type = other DNA
gatcaggcatagtttcggaagatca

SEQ ID NO: 430 - DNA, 32 bp, synthetic construct
  misc_feature 1..32: note = synthetic oligonucleotide
  source 1..32: mol_type = other DNA
cgacagacgcctgatcttccactaggcaaact

SEQ ID NO: 431 - DNA, 25 bp, synthetic construct
  misc_feature 1..25: note = synthetic oligonucleotide
  source 1..25: mol_type = other DNA
gatcagtttgcctagtggaagatca

SEQ ID NO: 432 - DNA, 32 bp, synthetic construct
  misc_feature 1..32: note = synthetic oligonucleotide
  source 1..32: mol_type = other DNA
cgacagacgcctgatcttccacgaatagcact

SEQ ID NO: 433 - DNA, 25 bp, synthetic construct
  misc_feature 1..25: note = synthetic oligonucleotide
  source 1..25: mol_type = other DNA
gatcagtgctattcgtggaagatca

SEQ ID NO: 434 - DNA, 32 bp, synthetic construct
  misc_feature 1..32: note = synthetic oligonucleotide
  source 1..32: mol_type = other DNA
cgacagacgcctgatcttccacgaaggaatct

SEQ ID NO: 435 - DNA, 25 bp, synthetic construct
  misc_feature 1..25: note = synthetic oligonucleotide
  source 1..25: mol_type = other DNA
gatcagattccttcgtggaagatca

SEQ ID NO: 436 - DNA, 32 bp, synthetic construct
  misc_feature 1..32: note = synthetic oligonucleotide
  source 1..32: mol_type = other DNA
cgacagacgcctgatcttccaccagagaactt

SEQ ID NO: 437 - DNA, 25 bp, synthetic construct
  misc_feature 1..25: note = synthetic oligonucleotide
  source 1..25: mol_type = other DNA
gatcaagttctctggtggaagatca

SEQ ID NO: 438 - DNA, 32 bp, synthetic construct
  misc_feature 1..32: note = synthetic oligonucleotide
  source 1..32: mol_type = other DNA
cgacagacgcctgatcttccacatacaggctt

SEQ ID NO: 439 - DNA, 25 bp, synthetic construct
  misc_feature 1..25: note = synthetic oligonucleotide
  source 1..25: mol_type = other DNA
gatcaagcctgtatgtggaagatca

SEQ ID NO: 440 - DNA, 32 bp, synthetic construct
  misc_feature 1..32: note = synthetic oligonucleotide
  source 1..32: mol_type = other DNA
cgacagacgcctgatcttccaagtccgtttct

SEQ ID NO: 441 - DNA, 25 bp, synthetic construct
  misc_feature 1..25: note = synthetic oligonucleotide
  source 1..25: mol_type = other DNA
gatcagaaacggacttggaagatca

SEQ ID NO: 442 - DNA, 32 bp, synthetic construct
  misc_feature 1..32: note = synthetic oligonucleotide
  source 1..32: mol_type = other DNA
cgacagacgcctgatcttcattctggcactct

SEQ ID NO: 443 - DNA, 25 bp, synthetic construct
  misc_feature 1..25: note = synthetic oligonucleotide
  source 1..25: mol_type = other DNA
gatcagagtgccagaatgaagatca

SEQ ID NO: 444 - DNA, 32 bp, synthetic construct
  misc_feature 1..32: note = synthetic oligonucleotide
  source 1..32: mol_type = other DNA
cgacagacgcctgatcttcatgtagtgtggct

SEQ ID NO: 445 - DNA, 25 bp, synthetic construct
  misc_feature 1..25: note = synthetic oligonucleotide
  source 1..25: mol_type = other DNA
gatcagccacactacatgaagatca

SEQ ID NO: 446 - DNA, 32 bp, synthetic construct
  misc_feature 1..32: note = synthetic oligonucleotide
  source 1..32: mol_type = other DNA
cgacagacgcctgatcttcatggttgtggact

SEQ ID NO: 447 - DNA, 25 bp, synthetic construct
  misc_feature 1..25: note = synthetic oligonucleotide
  source 1..25: mol_type = other DNA
gatcagtccacaaccatgaagatca

SEQ ID NO: 448 - DNA, 32 bp, synthetic construct
  misc_feature 1..32: note = synthetic oligonucleotide
  source 1..32: mol_type = other DNA
cgacagacgcctgatcttcatcttacacggct

SEQ ID NO: 449 - DNA, 25 bp, synthetic construct
  misc_feature 1..25: note = synthetic oligonucleotide
  source 1..25: mol_type = other DNA
gatcagccgtgtaagatgaagatca

SEQ ID NO: 450 - DNA, 32 bp, synthetic construct
  misc_feature 1..32: note = synthetic oligonucleotide
  source 1..32: mol_type = other DNA
cgacagacgcctgatcttcatacggaacacct

SEQ ID NO: 451 - DNA, 25 bp, synthetic construct
  misc_feature 1..25: note = synthetic oligonucleotide
  source 1..25: mol_type = other DNA
gatcaggtgttccgtatgaagatca

SEQ ID NO: 452 - DNA, 32 bp, synthetic construct
  misc_feature 1..32: note = synthetic oligonucleotide
  source 1..32: mol_type = other DNA
cgacagacgcctgatcttcataacactcggct

SEQ ID NO: 453 - DNA, 25 bp, synthetic construct
  misc_feature 1..25: note = synthetic oligonucleotide
  source 1..25: mol_type = other DNA
gatcagccgagtgttatgaagatca

SEQ ID NO: 454 - DNA, 32 bp, synthetic construct
  misc_feature 1..32: note = synthetic oligonucleotide
  source 1..32: mol_type = other DNA
cgacagacgcctgatcttcagtgaccaaacct

SEQ ID NO: 455 - DNA, 25 bp, synthetic construct
  misc_feature 1..25: note = synthetic oligonucleotide
  source 1..25: mol_type = other DNA
gatcaggtttggtcactgaagatca

SEQ ID NO: 456 - DNA, 32 bp, synthetic construct
  misc_feature 1..32: note = synthetic oligonucleotide
  source 1..32: mol_type = other DNA
cgacagacgcctgatcttcagtcattccgtct

SEQ ID NO: 457 - DNA, 25 bp, synthetic construct
  misc_feature 1..25: note = synthetic oligonucleotide
  source 1..25: mol_type = other DNA
gatcagacggaatgactgaagatca

SEQ ID NO: 458 - DNA, 32 bp, synthetic construct
  misc_feature 1..32: note = synthetic oligonucleotide
  source 1..32: mol_type = other DNA
cgacagacgcctgatcttcagcatggaaaggt

SEQ ID NO: 459 - DNA, 25 bp, synthetic construct
  misc_feature 1..25: note = synthetic oligonucleotide
  source 1..25: mol_type = other DNA
gatcacctttccatgctgaagatca

SEQ ID NO: 460 - DNA, 32 bp, synthetic construct
  misc_feature 1..32: note = synthetic oligonucleotide
  source 1..32: mol_type = other DNA
cgacagacgcctgatcttcagcaaagagtcct

SEQ ID NO: 461 - DNA, 25 bp, synthetic construct
  misc_feature 1..25: note = synthetic oligonucleotide
  source 1..25: mol_type = other DNA
gatcaggactctttgctgaagatca

SEQ ID NO: 462 - DNA, 32 bp, synthetic construct
  misc_feature 1..32: note = synthetic oligonucleotide
  source 1..32: mol_type = other DNA
cgacagacgcctgatcttcagagtagagcgtt

SEQ ID NO: 463 - DNA, 25 bp, synthetic construct
  misc_feature 1..25: note = synthetic oligonucleotide
  source 1..25: mol_type = other DNA
gatcaacgctctactctgaagatca

SEQ ID NO: 464 - DNA, 32 bp, synthetic construct
  misc_feature 1..32: note = synthetic oligonucleotide
  source 1..32: mol_type = other DNA
cgacagacgcctgatcttcagaaggagttgct

SEQ ID NO: 465 - DNA, 25 bp, synthetic construct
  misc_feature 1..25: note = synthetic oligonucleotide
  source 1..25: mol_type = other DNA
gatcagcaactccttctgaagatca

SEQ ID NO: 466 - DNA, 32 bp, synthetic construct
  misc_feature 1..32: note = synthetic oligonucleotide
  source 1..32: mol_type = other DNA
cgacagacgcctgatcttcacttagcggaact

SEQ ID NO: 467 - DNA, 25 bp, synthetic construct
  misc_feature 1..25: note = synthetic oligonucleotide
  source 1..25: mol_type = other DNA
gatcagttccgctaagtgaagatca

SEQ ID NO: 468 - DNA, 32 bp, synthetic construct
  misc_feature 1..32: note = synthetic oligonucleotide
  source 1..32: mol_type = other DNA
cgacagacgcctgatcttcacggaggaaatgt

SEQ ID NO: 469 - DNA, 25 bp, synthetic construct
  misc_feature 1..25: note = synthetic oligonucleotide
  source 1..25: mol_type = other DNA
gatcacatttcctccgtgaagatca

SEQ ID NO: 470 - DNA, 32 bp, synthetic construct
  misc_feature 1..32: note = synthetic oligonucleotide
  source 1..32: mol_type = other DNA
cgacagacgcctgatcttcacacctggaaact

SEQ ID NO: 471 - DNA, 25 bp, synthetic construct
  misc_feature 1..25: note = synthetic oligonucleotide
  source 1..25: mol_type = other DNA
gatcagtttccaggtgtgaagatca

SEQ ID NO: 472 - DNA, 32 bp, synthetic construct
  misc_feature 1..32: note = synthetic oligonucleotide
  source 1..32: mol_type = other DNA
cgacagacgcctgatcttcacaatctcaggct

SEQ ID NO: 473 - DNA, 25 bp, synthetic construct
  misc_feature 1..25: note = synthetic oligonucleotide
  source 1..25: mol_type = other DNA
gatcagcctgagattgtgaagatca

SEQ ID NO: 474 - DNA, 32 bp, synthetic construct
  misc_feature 1..32: note = synthetic oligonucleotide
  source 1..32: mol_type = other DNA
cgacagacgcctgatcttcaatgagtgtccgt

SEQ ID NO: 475 - DNA, 25 bp, synthetic construct
  misc_feature 1..25: note = synthetic oligonucleotide
  source 1..25: mol_type = other DNA
gatcacggacactcattgaagatca

SEQ ID NO: 476 - DNA, 32 bp, synthetic construct
  misc_feature 1..32: note = synthetic oligonucleotide
  source 1..32: mol_type = other DNA
cgacagacgcctgatcttcaatcacagagcct

SEQ ID NO: 477 - DNA, 25 bp, synthetic construct
  misc_feature 1..25: note = synthetic oligonucleotide
  source 1..25: mol_type = other DNA
gatcaggctctgtgattgaagatca

SEQ ID NO: 478 - DNA, 32 bp, synthetic construct
  misc_feature 1..32: note = synthetic oligonucleotide
  source 1..32: mol_type = other DNA
cgacagacgcctgatcttcaaggctgaaaggt

SEQ ID NO: 479 - DNA, 25 bp, synthetic construct
  misc_feature 1..25: note = synthetic oligonucleotide
  source 1..25: mol_type = other DNA
gatcacctttcagccttgaagatca

SEQ ID NO: 480 - DNA, 32 bp, synthetic construct
  misc_feature 1..32: note = synthetic oligonucleotide
  source 1..32: mol_type = other DNA
cgacagacgcctgatcttcaagactaaccgct

SEQ ID NO: 481 - DNA, 25 bp, synthetic construct
  misc_feature 1..25: note = synthetic oligonucleotide
  source 1..25: mol_type = other DNA
gatcagcggttagtcttgaagatca

SEQ ID NO: 482 - DNA, 32 bp, synthetic construct
  misc_feature 1..32: note = synthetic oligonucleotide
  source 1..32: mol_type = other DNA
cgacagacgcctgatcttcaaccagtaagcct

SEQ ID NO: 483 - DNA, 25 bp, synthetic construct
  misc_feature 1..25: note = synthetic oligonucleotide
  source 1..25: mol_type = other DNA
gatcaggcttactggttgaagatca

SEQ ID NO: 484 - DNA, 32 bp, synthetic construct
  misc_feature 1..32: note = synthetic oligonucleotide
  source 1..32: mol_type = other DNA
cgacagacgcctgatcttcaaagtatccgcct

SEQ ID NO: 485 - DNA, 25 bp, synthetic construct
  misc_feature 1..25: note = synthetic oligonucleotide
  source 1..25: mol_type = other DNA
gatcaggcggatactttgaagatca

SEQ ID NO: 486 - DNA, 32 bp, synthetic construct
  misc_feature 1..32: note = synthetic oligonucleotide
  source 1..32: mol_type = other DNA
cgacagacgcctgatcttattgccgagttcct

SEQ ID NO: 487 - DNA, 25 bp, synthetic construct
  misc_feature 1..25: note = synthetic oligonucleotide
  source 1..25: mol_type = other DNA
gatcaggaactcggcaataagatca

SEQ ID NO: 488 - DNA, 32 bp, synthetic construct
  misc_feature 1..32: note = synthetic oligonucleotide
  source 1..32: mol_type = other DNA
cgacagacgcctgatcttattgccaccacagt

SEQ ID NO: 489 - DNA, 25 bp, synthetic construct
  misc_feature 1..25: note = synthetic oligonucleotide
  source 1..25: mol_type = other DNA
gatcactgtggtggcaataagatca

SEQ ID NO: 490 - DNA, 32 bp, synthetic construct
  misc_feature 1..32: note = synthetic oligonucleotide
  source 1..32: mol_type = other DNA
cgacagacgcctgatcttattccgaacctgct

SEQ ID NO: 491 - DNA, 25 bp, synthetic construct
  misc_feature 1..25: note = synthetic oligonucleotide
  source 1..25: mol_type = other DNA
gatcagcaggttcggaataagatca

SEQ ID NO: 492 - DNA, 32 bp, synthetic construct
  misc_feature 1..32: note = synthetic oligonucleotide
  source 1..32: mol_type = other DNA
cgacagacgcctgatcttattcagccgttcct

SEQ ID NO: 493 - DNA, 25 bp, synthetic construct
  misc_feature 1..25: note = synthetic oligonucleotide
  source 1..25: mol_type = other DNA
gatcaggaacggctgaataagatca

SEQ ID NO: 494 - DNA, 32 bp, synthetic construct
  misc_feature 1..32: note = synthetic oligonucleotide
  source 1..32: mol_type = other DNA
cgacagacgcctgatcttatgttgccaggtgt

SEQ ID NO: 495 - DNA, 25 bp, synthetic construct
  misc_feature 1..25: note = synthetic oligonucleotide
  source 1..25: mol_type = other DNA
gatcacacctggcaacataagatca

SEQ ID NO: 496 - DNA, 32 bp, synthetic construct
  misc_feature 1..32: note = synthetic oligonucleotide
  source 1..32: mol_type = other DNA
cgacagacgcctgatcttatgcacacagacct

SEQ ID NO: 497 - DNA, 25 bp, synthetic construct
  misc_feature 1..25: note = synthetic oligonucleotide
  source 1..25: mol_type = other DNA
gatcaggtctgtgtgcataagatca

SEQ ID NO: 498 - DNA, 32 bp, synthetic construct
  misc_feature 1..32: note = synthetic oligonucleotide
  source 1..32: mol_type = other DNA
cgacagacgcctgatcttatgcaaggagtcgt

SEQ ID NO: 499 - DNA, 25 bp, synthetic construct
  misc_feature 1..25: note = synthetic oligonucleotide
  source 1..25: mol_type = other DNA
gatcacgactccttgcataagatca

SEQ ID NO: 500 - DNA, 32 bp, synthetic construct
  misc_feature 1..32: note = synthetic oligonucleotide
  source 1..32: mol_type = other DNA
cgacagacgcctgatcttatctcgactgcctt

SEQ ID NO: 501 - DNA, 25 bp, synthetic construct
  misc_feature 1..25: note = synthetic oligonucleotide
  source 1..25: mol_type = other DNA
gatcaaggcagtcgagataagatca

SEQ ID NO: 502 - DNA, 32 bp, synthetic construct
  misc_feature 1..32: note = synthetic oligonucleotide
  source 1..32: mol_type = other DNA
cgacagacgcctgatcttatcgccaagaaggt

SEQ ID NO: 503 - DNA, 25 bp, synthetic construct
  misc_feature 1..25: note = synthetic oligonucleotide
  source 1..25: mol_type = other DNA
gatcaccttcttggcgataagatca

SEQ ID NO: 504 - DNA, 32 bp, synthetic construct
  misc_feature 1..32: note = synthetic oligonucleotide
  source 1..32: mol_type = other DNA
cgacagacgcctgatcttatcgcacctcaagt

SEQ ID NO: 505 - DNA, 25 bp, synthetic construct
  misc_feature 1..25: note = synthetic oligonucleotide
  source 1..25: mol_type = other DNA
gatcacttgaggtgcgataagatca

SEQ ID NO: 506 - DNA, 32 bp, synthetic construct
  misc_feature 1..32: note = synthetic oligonucleotide
  source 1..32: mol_type = other DNA
cgacagacgcctgatcttatcgattggctggt

SEQ ID NO: 507 - DNA, 25 bp, synthetic construct
  misc_feature 1..25: note = synthetic oligonucleotide
  source 1..25: mol_type = other DNA
gatcaccagccaatcgataagatca

SEQ ID NO: 508 - DNA, 32 bp, synthetic construct
  misc_feature 1..32: note = synthetic oligonucleotide
  source 1..32: mol_type = other DNA
cgacagacgcctgatcttatcattgccgacct

SEQ ID NO: 509 - DNA, 25 bp, synthetic construct
  misc_feature 1..25: note = synthetic oligonucleotide
  source 1..25: mol_type = other DNA
gatcaggtcggcaatgataagatca

SEQ ID NO: 510 - DNA, 32 bp, synthetic construct
  misc_feature 1..32: note = synthetic oligonucleotide
  source 1..32: mol_type = other DNA
cgacagacgcctgatcttatcaggtgttcgct

SEQ ID NO: 511 - DNA, 25 bp, synthetic construct
  misc_feature 1..25: note = synthetic oligonucleotide
  source 1..25: mol_type = other DNA
gatcagcgaacacctgataagatca

SEQ ID NO: 512 - DNA, 32 bp, synthetic construct
  misc_feature 1..32: note = synthetic oligonucleotide
  source 1..32: mol_type = other DNA
cgacagacgcctgatcttataggcggaaacgt

SEQ ID NO: 513 - DNA, 25 bp, synthetic construct
  misc_feature 1..25: note = synthetic oligonucleotide
  source 1..25: mol_type = other DNA
gatcacgtttccgcctataagatca

SEQ ID NO: 514 - DNA, 32 bp, synthetic construct
  misc_feature 1..32: note = synthetic oligonucleotide
  source 1..32: mol_type = other DNA
cgacagacgcctgatcttataggagcgagcat

SEQ ID NO: 515 - DNA, 25 bp, synthetic construct
  misc_feature 1..25: note = synthetic oligonucleotide
  source 1..25: mol_type = other DNA
gatcatgctcgctcctataagatca

SEQ ID NO: 516 - DNA, 32 bp, synthetic construct
  misc_feature 1..32: note = synthetic oligonucleotide
  source 1..32: mol_type = other DNA
cgacagacgcctgatcttatagaacgcacggt

SEQ ID NO: 517 - DNA, 25 bp, synthetic construct
  misc_feature 1..25: note = synthetic oligonucleotide
  source 1..25: mol_type = other DNA
gatcaccgtgcgttctataagatca

SEQ ID NO: 518 - DNA, 32 bp, synthetic construct
  misc_feature 1..32: note = synthetic oligonucleotide
  source 1..32: mol_type = other DNA
cgacagacgcctgatcttatacggcacaaggt

SEQ ID NO: 519 - DNA, 25 bp, synthetic construct
  misc_feature 1..25: note = synthetic oligonucleotide
  source 1..25: mol_type = other DNA
gatcaccttgtgccgtataagatca

SEQ ID NO: 520 - DNA, 32 bp, synthetic construct
  misc_feature 1..32: note = synthetic oligonucleotide
  source 1..32: mol_type = other DNA
cgacagacgcctgatcttataccttgtgccgt

SEQ ID NO: 521 - DNA, 25 bp, synthetic construct
  misc_feature 1..25: note = synthetic oligonucleotide
  source 1..25: mol_type = other DNA
gatcacggcacaaggtataagatca

SEQ ID NO: 522 - DNA, 32 bp, synthetic construct
  misc_feature 1..32: note = synthetic oligonucleotide
  source 1..32: mol_type = other DNA
cgacagacgcctgatcttataagccttgccgt

SEQ ID NO: 523 - DNA, 25 bp, synthetic construct
  misc_feature 1..25: note = synthetic oligonucleotide
  source 1..25: mol_type = other DNA
gatcacggcaaggcttataagatca

SEQ ID NO: 524 - DNA, 32 bp, synthetic construct
  misc_feature 1..32: note = synthetic oligonucleotide
  source 1..32: mol_type = other DNA
cgacagacgcctgatcttagttaacaccgcct

SEQ ID NO: 525 - DNA, 25 bp, synthetic construct
  misc_feature 1..25: note = synthetic oligonucleotide
  source 1..25: mol_type = other DNA
gatcaggcggtgttaactaagatca

SEQ ID NO: 526 - DNA, 32 bp, synthetic construct
  misc_feature 1..32: note = synthetic oligonucleotide
  source 1..32: mol_type = other DNA
cgacagacgcctgatcttagtctatggcggtt

SEQ ID NO: 527 - DNA, 25 bp, synthetic construct
  misc_feature 1..25: note = synthetic oligonucleotide
  source 1..25: mol_type = other DNA
gatcaaccgccatagactaagatca

SEQ ID NO: 528 - DNA, 32 bp, synthetic construct
  misc_feature 1..32: note = synthetic oligonucleotide
  source 1..32: mol_type = other DNA
cgacagacgcctgatcttagtaccgctttggt

SEQ ID NO: 529 - DNA, 25 bp, synthetic construct
  misc_feature 1..25: note = synthetic oligonucleotide
  source 1..25: mol_type = other DNA
gatcaccaaagcggtactaagatca

SEQ ID NO: 530 - DNA, 32 bp, synthetic construct
  misc_feature 1..32: note = synthetic oligonucleotide
  source 1..32: mol_type = other DNA
cgacagacgcctgatcttaggtggctttacgt

SEQ ID NO: 531 - DNA, 25 bp, synthetic construct
  misc_feature 1..25: note = synthetic oligonucleotide
  source 1..25: mol_type = other DNA
gatcacgtaaagccacctaagatca

SEQ ID NO: 532 - DNA, 32 bp, synthetic construct
  misc_feature 1..32: note = synthetic oligonucleotide
  source 1..32: mol_type = other DNA
cgacagacgcctgatcttaggtacggctttgt

SEQ ID NO: 533 - DNA, 25 bp, synthetic construct
  misc_feature 1..25: note = synthetic oligonucleotide
  source 1..25: mol_type = other DNA
gatcacaaagccgtacctaagatca

SEQ ID NO: 534 - DNA, 32 bp, synthetic construct
  misc_feature 1..32: note = synthetic oligonucleotide
  source 1..32: mol_type = other DNA
cgacagacgcctgatcttaggcttcactggtt

SEQ ID NO: 535 - DNA, 25 bp, synthetic construct
  misc_feature 1..25: note = synthetic oligonucleotide
  source 1..25: mol_type = other DNA
gatcaaccagtgaagcctaagatca

SEQ ID NO: 536 - DNA, 32 bp, synthetic construct
  misc_feature 1..32: note = synthetic oligonucleotide
  source 1..32: mol_type = other DNA
cgacagacgcctgatcttaggccatcaacact

SEQ ID NO: 537 - DNA, 25 bp, synthetic construct
  misc_feature 1..25: note = synthetic oligonucleotide
  source 1..25: mol_type = other DNA
gatcagtgttgatggcctaagatca

SEQ ID NO: 538 - DNA, 32 bp, synthetic construct
  misc_feature 1..32: note = synthetic oligonucleotide
  source 1..32: mol_type = other DNA
cgacagacgcctgatcttaggattgaacggct

SEQ ID NO: 539 - DNA, 25 bp, synthetic construct
  misc_feature 1..25: note = synthetic oligonucleotide
  source 1..25: mol_type = other DNA
gatcagccgttcaatcctaagatca

SEQ ID NO: 540 - DNA, 32 bp, synthetic construct
  misc_feature 1..32: note = synthetic oligonucleotide
  source 1..32: mol_type = other DNA
cgacagacgcctgatcttagctcaaacgtcct

SEQ ID NO: 541 - DNA, 25 bp, synthetic construct
  misc_feature 1..25: note = synthetic oligonucleotide
  source 1..25: mol_type = other DNA
gatcaggacgtttgagctaagatca

SEQ ID NO: 542 - DNA, 32 bp, synthetic construct
  misc_feature 1..32: note = synthetic oligonucleotide
  source 1..32: mol_type = other DNA
cgacagacgcctgatcttagcggattggttct

SEQ ID NO: 543 - DNA, 25 bp, synthetic construct
  misc_feature 1..25: note = synthetic oligonucleotide
  source 1..25: mol_type = other DNA
gatcagaaccaatccgctaagatca

SEQ ID NO: 544 - DNA, 32 bp, synthetic construct
  misc_feature 1..32: note = synthetic oligonucleotide
  source 1..32: mol_type = other DNA
cgacagacgcctgatcttagatttccacggct

SEQ ID NO: 545 - DNA, 25 bp, synthetic construct
  misc_feature 1..25: note = synthetic oligonucleotide
  source 1..25: mol_type = other DNA
gatcagccgtggaaatctaagatca

SEQ ID NO: 546 - DNA, 32 bp, synthetic construct
  misc_feature 1..32: note = synthetic oligonucleotide
  source 1..32: mol_type = other DNA
cgacagacgcctgatcttagattgccgagtgt

SEQ ID NO: 547 - DNA, 25 bp, synthetic construct
  misc_feature 1..25: note = synthetic oligonucleotide
  source 1..25: mol_type = other DNA
gatcacactcggcaatctaagatca

SEQ ID NO: 548 - DNA, 32 bp, synthetic construct
  misc_feature 1..32: note = synthetic oligonucleotide
  source 1..32: mol_type = other DNA
cgacagacgcctgatcttagaacgtggaagct

SEQ ID NO: 549 - DNA, 25 bp, synthetic construct
  misc_feature 1..25: note = synthetic oligonucleotide
  source 1..25: mol_type = other DNA
gatcagcttccacgttctaagatca

SEQ ID NO: 550 - DNA, 32 bp, synthetic construct
  misc_feature 1..32: note = synthetic oligonucleotide
  source 1..32: mol_type = other DNA
cgacagacgcctgatcttagaaactccgcact

SEQ ID NO: 551 - DNA, 25 bp, synthetic construct
  misc_feature 1..25: note = synthetic oligonucleotide
  source 1..25: mol_type = other DNA
gatcagtgcggagtttctaagatca

SEQ ID NO: 552 - DNA, 32 bp, synthetic construct
  misc_feature 1..32: note = synthetic oligonucleotide
  source 1..32: mol_type = other DNA
cgacagacgcctgatcttacttcggacaacct

SEQ ID NO: 553 - DNA, 25 bp, synthetic construct
  misc_feature 1..25: note = synthetic oligonucleotide
  source 1..25: mol_type = other DNA
gatcaggttgtccgaagtaagatca

SEQ ID NO: 554 - DNA, 32 bp, synthetic construct
  misc_feature 1..32: note = synthetic oligonucleotide
  source 1..32: mol_type = other DNA
cgacagacgcctgatcttactgtatccgcctt

SEQ ID NO: 555 - DNA, 25 bp, synthetic construct
  misc_feature 1..25: note = synthetic oligonucleotide
  source 1..25: mol_type = other DNA
gatcaaggcggatacagtaagatca

SEQ ID NO: 556 - DNA, 32 bp, synthetic construct
  misc_feature 1..32: note = synthetic oligonucleotide
  source 1..32: mol_type = other DNA
cgacagacgcctgatcttactgctgactcctt

SEQ ID NO: 557 - DNA, 25 bp, synthetic construct
  misc_feature 1..25: note = synthetic oligonucleotide
  source 1..25: mol_type = other DNA
gatcaaggagtcagcagtaagatca

SEQ ID NO: 558 - DNA, 32 bp, synthetic construct
  misc_feature 1..32: note = synthetic oligonucleotide
  source 1..32: mol_type = other DNA
cgacagacgcctgatcttactcgtgaaagcct

SEQ ID NO: 559 - DNA, 25 bp, synthetic construct
  misc_feature 1..25: note = synthetic oligonucleotide
  source 1..25: mol_type = other DNA
gatcaggctttcacgagtaagatca

SEQ ID NO: 560 - DNA, 32 bp, synthetic construct
  misc_feature 1..32: note = synthetic oligonucleotide
  source 1..32: mol_type = other DNA
cgacagacgcctgatcttactcgaagccaact

SEQ ID NO: 561 - DNA, 25 bp, synthetic construct
  misc_feature 1..25: note = synthetic oligonucleotide
  source 1..25: mol_type = other DNA
gatcagttggcttcgagtaagatca

SEQ ID NO: 562 - DNA, 32 bp, synthetic construct
  misc_feature 1..32: note = synthetic oligonucleotide
  source 1..32: mol_type = other DNA
cgacagacgcctgatcttactccagtttgcct

SEQ ID NO: 563 - DNA, 25 bp, synthetic construct
  misc_feature 1..25: note = synthetic oligonucleotide
  source 1..25: mol_type = other DNA
gatcaggcaaactggagtaagatca

SEQ ID NO: 564 - DNA, 32 bp, synthetic construct
  misc_feature 1..32: note = synthetic oligonucleotide
  source 1..32: mol_type = other DNA
cgacagacgcctgatcttactattgtggcggt

SEQ ID NO: 565 - DNA, 25 bp, synthetic construct
  misc_feature 1..25: note = synthetic oligonucleotide
  source 1..25: mol_type = other DNA
gatcaccgccacaatagtaagatca

SEQ ID NO: 566 - DNA, 32 bp, synthetic construct
  misc_feature 1..32: note = synthetic oligonucleotide
  source 1..32: mol_type = other DNA
cgacagacgcctgatcttactagacacacgct

SEQ ID NO: 567 - DNA, 25 bp, synthetic construct
  misc_feature 1..25: note = synthetic oligonucleotide
  source 1..25: mol_type = other DNA
gatcagcgtgtgtctagtaagatca

SEQ ID NO: 568 - DNA, 32 bp, synthetic construct
  misc_feature 1..32: note = synthetic oligonucleotide
  source 1..32: mol_type = other DNA
cgacagacgcctgatcttacggtctttccact

SEQ ID NO: 569 - DNA, 25 bp, synthetic construct
  misc_feature 1..25: note = synthetic oligonucleotide
  source 1..25: mol_type = other DNA
gatcagtggaaagaccgtaagatca

SEQ ID NO: 570 - DNA, 32 bp, synthetic construct
  misc_feature 1..32: note = synthetic oligonucleotide
  source 1..32: mol_type = other DNA
cgacagacgcctgatcttacctaacagccgat

SEQ ID NO: 571 - DNA, 25 bp, synthetic construct
  misc_feature 1..25: note = synthetic oligonucleotide
  source 1..25: mol_type = other DNA
gatcatcggctgttaggtaagatca

SEQ ID NO: 572 - DNA, 32 bp, synthetic construct
  misc_feature 1..32: note = synthetic oligonucleotide
  source 1..32: mol_type = other DNA
cgacagacgcctgatcttaccggtggttagtt

SEQ ID NO: 573 - DNA, 25 bp, synthetic construct
  misc_feature 1..25: note = synthetic oligonucleotide
  source 1..25: mol_type = other DNA
gatcaactaaccaccggtaagatca

SEQ ID NO: 574 - DNA, 32 bp, synthetic construct
  misc_feature 1..32: note = synthetic oligonucleotide
  source 1..32: mol_type = other DNA
cgacagacgcctgatcttaccataagtgccgt

SEQ ID NO: 575 - DNA, 25 bp, synthetic construct
  misc_feature 1..25: note = synthetic oligonucleotide
  source 1..25: mol_type = other DNA
gatcacggcacttatggtaagatca

SEQ ID NO: 576 - DNA, 32 bp, synthetic construct
  misc_feature 1..32: note = synthetic oligonucleotide
  source 1..32: mol_type = other DNA
cgacagacgcctgatcttaccaatgtccagct

SEQ ID NO: 577 - DNA, 25 bp, synthetic construct
  misc_feature 1..25: note = synthetic oligonucleotide
  source 1..25: mol_type = other DNA
gatcagctggacattggtaagatca

SEQ ID NO: 578 - DNA, 32 bp, synthetic construct
  misc_feature 1..32: note = synthetic oligonucleotide
  source 1..32: mol_type = other DNA
cgacagacgcctgatcttacatgttcgctcct

SEQ ID NO: 579 - DNA, 25 bp, synthetic construct
  misc_feature 1..25: note = synthetic oligonucleotide
  source 1..25: mol_type = other DNA
gatcaggagcgaacatgtaagatca

SEQ ID NO: 580 - DNA, 32 bp, synthetic construct
  misc_feature 1..32: note = synthetic oligonucleotide
  source 1..32: mol_type = other DNA
cgacagacgcctgatcttacatcatccagcgt

SEQ ID NO: 581 - DNA, 25 bp, synthetic construct
  misc_feature 1..25: note = synthetic oligonucleotide
  source 1..25: mol_type = other DNA
gatcacgctggatgatgtaagatca

SEQ ID NO: 582 - DNA, 32 bp, synthetic construct
  misc_feature 1..32: note = synthetic oligonucleotide
  source 1..32: mol_type = other DNA
cgacagacgcctgatcttacacaagatcgcct

SEQ ID NO: 583 - DNA, 25 bp, synthetic construct
  misc_feature 1..25: note = synthetic oligonucleotide
  source 1..25: mol_type = other DNA
gatcaggcgatcttgtgtaagatca

SEQ ID NO: 584 - DNA, 32 bp, synthetic construct
  misc_feature 1..32: note = synthetic oligonucleotide
  source 1..32: mol_type = other DNA
cgacagacgcctgatcttacaaagtccgtcct

SEQ ID NO: 585 - DNA, 25 bp, synthetic construct
  misc_feature 1..25: note = synthetic oligonucleotide
  source 1..25: mol_type = other DNA
gatcaggacggactttgtaagatca

SEQ ID NO: 586 - DNA, 32 bp, synthetic construct
  misc_feature 1..32: note = synthetic oligonucleotide
  source 1..32: mol_type = other DNA
cgacagacgcctgatcttaattcgtccgtcct

SEQ ID NO: 587 - DNA, 25 bp, synthetic construct
  misc_feature 1..25: note = synthetic oligonucleotide
  source 1..25: mol_type = other DNA
gatcaggacggacgaattaagatca

SEQ ID NO: 588 - DNA, 32 bp, synthetic construct
  misc_feature 1..32: note = synthetic oligonucleotide
  source 1..32: mol_type = other DNA
cgacagacgcctgatcttaatgaggagcacgt

SEQ ID NO: 589 - DNA, 25 bp, synthetic construct
  misc_feature 1..25: note = synthetic oligonucleotide
  source 1..25: mol_type = other DNA
gatcacgtgctcctcattaagatca

SEQ ID NO: 590 - DNA, 32 bp, synthetic construct
  misc_feature 1..32: note = synthetic oligonucleotide
  source 1..32: mol_type = other DNA
cgacagacgcctgatcttaagtgaagaccgct

SEQ ID NO: 591 - DNA, 25 bp, synthetic construct
  misc_feature 1..25: note = synthetic oligonucleotide
  source 1..25: mol_type = other DNA
gatcagcggtcttcacttaagatca

SEQ ID NO: 592 - DNA, 32 bp, synthetic construct
  misc_feature 1..32: note = synthetic oligonucleotide
  source 1..32: mol_type = other DNA
cgacagacgcctgatcttaagtcgtggttcgt

SEQ ID NO: 593 - DNA, 25 bp, synthetic construct
  misc_feature 1..25: note = synthetic oligonucleotide
  source 1..25: mol_type = other DNA
gatcacgaaccacgacttaagatca

SEQ ID NO: 594 - DNA, 32 bp, synthetic construct
  misc_feature 1..32: note = synthetic oligonucleotide
  source 1..32: mol_type = other DNA
cgacagacgcctgatcttaagctctccgttgt

SEQ ID NO: 595 - DNA, 25 bp, synthetic construct
  misc_feature 1..25: note = synthetic oligonucleotide
  source 1..25: mol_type = other DNA
gatcacaacggagagcttaagatca

SEQ ID NO: 596 - DNA, 32 bp, synthetic construct
  misc_feature 1..32: note = synthetic oligonucleotide
  source 1..32: mol_type = other DNA
cgacagacgcctgatcttaagccactccagat

SEQ ID NO: 597 - DNA, 25 bp, synthetic construct
  misc_feature 1..25: note = synthetic oligonucleotide
  source 1..25: mol_type = other DNA
gatcatctggagtggcttaagatca

SEQ ID NO: 598 - DNA, 32 bp, synthetic construct
  misc_feature 1..32: note = synthetic oligonucleotide
  source 1..32: mol_type = other DNA
cgacagacgcctgatcttaagagaggtgccat

SEQ ID NO: 599 - DNA, 25 bp, synthetic construct
  misc_feature 1..25: note = synthetic oligonucleotide
  source 1..25: mol_type = other DNA
gatcatggcacctctcttaagatca

SEQ ID NO: 600 - DNA, 32 bp, synthetic construct
  misc_feature 1..32: note = synthetic oligonucleotide
  source 1..32: mol_type = other DNA
cgacagacgcctgatcttaagacctcaccgat

SEQ ID NO: 601 - DNA, 25 bp, synthetic construct
  misc_feature 1..25: note = synthetic oligonucleotide
  source 1..25: mol_type = other DNA
gatcatcggtgaggtcttaagatca

SEQ ID NO: 602 - DNA, 32 bp, synthetic construct
  misc_feature 1..32: note = synthetic oligonucleotide
  source 1..32: mol_type = other DNA
cgacagacgcctgatcttaactcaaccggact

SEQ ID NO: 603 - DNA, 25 bp, synthetic construct
  misc_feature 1..25: note = synthetic oligonucleotide
  source 1..25: mol_type = other DNA
gatcagtccggttgagttaagatca

SEQ ID NO: 604 - DNA, 32 bp, synthetic construct
  misc_feature 1..32: note = synthetic oligonucleotide
  source 1..32: mol_type = other DNA
cgacagacgcctgatcttaacctctcgcttgt

SEQ ID NO: 605 - DNA, 25 bp, synthetic construct
  misc_feature 1..25: note = synthetic oligonucleotide
  source 1..25: mol_type = other DNA
gatcacaagcgagaggttaagatca

SEQ ID NO: 606 - DNA, 32 bp, synthetic construct
  misc_feature 1..32: note = synthetic oligonucleotide
  source 1..32: mol_type = other DNA
cgacagacgcctgatcttaaccgctttcctgt

SEQ ID NO: 607 - DNA, 25 bp, synthetic construct
  misc_feature 1..25: note = synthetic oligonucleotide
  source 1..25: mol_type = other DNA
gatcacaggaaagcggttaagatca

SEQ ID NO: 608 - DNA, 32 bp, synthetic construct
  misc_feature 1..32: note = synthetic oligonucleotide
  source 1..32: mol_type = other DNA
cgacagacgcctgatcttaacactctggcact

SEQ ID NO: 609 - DNA, 25 bp, synthetic construct
  misc_feature 1..25: note = synthetic oligonucleotide
  source 1..25: mol_type = other DNA
gatcagtgccagagtgttaagatca

SEQ ID NO: 610 - DNA, 32 bp, synthetic construct
  misc_feature 1..32: note = synthetic oligonucleotide
  source 1..32: mol_type = other DNA
cgacagacgcctgatcttaaatgcggaggact

SEQ ID NO: 611 - DNA, 25 bp, synthetic construct
  misc_feature 1..25: note = synthetic oligonucleotide
  source 1..25: mol_type = other DNA
gatcagtcctccgcatttaagatca

SEQ ID NO: 612 - DNA, 32 bp, synthetic construct
  misc_feature 1..32: note = synthetic oligonucleotide
  source 1..32: mol_type = other DNA
cgacagacgcctgatcttaaataggctggcgt

SEQ ID NO: 613 - DNA, 25 bp, synthetic construct
  misc_feature 1..25: note = synthetic oligonucleotide
  source 1..25: mol_type = other DNA
gatcacgccagcctatttaagatca

SEQ ID NO: 614 - DNA, 32 bp, synthetic construct
  misc_feature 1..32: note = synthetic oligonucleotide
  source 1..32: mol_type = other DNA
cgacagacgcctgatcttaaacctcggacact

SEQ ID NO: 615 - DNA, 25 bp, synthetic construct
  misc_feature 1..25: note = synthetic oligonucleotide
  source 1..25: mol_type = other DNA
gatcagtgtccgaggtttaagatca

SEQ ID NO: 616 - DNA, 32 bp, synthetic construct
  misc_feature 1..32: note = synthetic oligonucleotide
  source 1..32: mol_type = other DNA
cgacagacgcctgatctgtttgaaccgaggat

SEQ ID NO: 617 - DNA, 25 bp, synthetic construct
  misc_feature 1..25: note = synthetic oligonucleotide
  source 1..25: mol_type = other DNA
gatcatcctcggttcaaacagatca

SEQ ID NO: 618 - DNA, 32 bp, synthetic construct
  misc_feature 1..32: note = synthetic oligonucleotide
  source 1..32: mol_type = other DNA
cgacagacgcctgatctgtttcgacttcacgt

SEQ ID NO: 619 - DNA, 25 bp, synthetic construct
  misc_feature 1..25: note = synthetic oligonucleotide
  source 1..25: mol_type = other DNA
gatcacgtgaagtcgaaacagatca

SEQ ID NO: 620 - DNA, 32 bp, synthetic construct
  misc_feature 1..32: note = synthetic oligonucleotide
  source 1..32: mol_type = other DNA
cgacagacgcctgatctgtttcacgaccaagt

SEQ ID NO: 621 - DNA, 25 bp, synthetic construct
  misc_feature 1..25: note = synthetic oligonucleotide
  source 1..25: mol_type = other DNA
gatcacttggtcgtgaaacagatca

SEQ ID NO: 622 - DNA, 32 bp, synthetic construct
  misc_feature 1..32: note = synthetic oligonucleotide
  source 1..32: mol_type = other DNA
cgacagacgcctgatctgtttatgccactcgt

SEQ ID NO: 623 - DNA, 25 bp, synthetic construct
  misc_feature 1..25: note = synthetic oligonucleotide
  source 1..25: mol_type = other DNA
gatcacgagtggcataaacagatca

SEQ ID NO: 624 - DNA, 32 bp, synthetic construct
  misc_feature 1..32: note = synthetic oligonucleotide
  source 1..32: mol_type = other DNA
cgacagacgcctgatctgtttaatcgaccgct

SEQ ID NO: 625 - DNA, 25 bp, synthetic construct
  misc_feature 1..25: note = synthetic oligonucleotide
  source 1..25: mol_type = other DNA
gatcagcggtcgattaaacagatca

SEQ ID NO: 626 - DNA, 32 bp, synthetic construct
  misc_feature 1..32: note = synthetic oligonucleotide
  source 1..32: mol_type = other DNA
cgacagacgcctgatctgttgtaatggctcgt

SEQ ID NO: 627 - DNA, 25 bp, synthetic construct
  misc_feature 1..25: note = synthetic oligonucleotide
  source 1..25: mol_type = other DNA
gatcacgagccattacaacagatca

SEQ ID NO: 628 - DNA, 32 bp, synthetic construct
  misc_feature 1..32: note = synthetic oligonucleotide
  source 1..32: mol_type = other DNA
cgacagacgcctgatctgttggttcaagtcgt

SEQ ID NO: 629 - DNA, 25 bp, synthetic construct
  misc_feature 1..25: note = synthetic oligonucleotide
  source 1..25: mol_type = other DNA
gatcacgacttgaaccaacagatca

SEQ ID NO: 630 - DNA, 32 bp, synthetic construct
  misc_feature 1..32: note = synthetic oligonucleotide
  source 1..32: mol_type = other DNA
cgacagacgcctgatctgttggtaactggctt

SEQ ID NO: 631 - DNA, 25 bp, synthetic construct
  misc_feature 1..25: note = synthetic oligonucleotide
  source 1..25: mol_type = other DNA
gatcaagccagttaccaacagatca

SEQ ID NO: 632 - DNA, 32 bp, synthetic construct
  misc_feature 1..32: note = synthetic oligonucleotide
  source 1..32: mol_type = other DNA
cgacagacgcctgatctgttggcataacgagt

SEQ ID NO: 633 - DNA, 25 bp, synthetic construct
  misc_feature 1..25: note = synthetic oligonucleotide
  source 1..25: mol_type = other DNA
gatcactcgttatgccaacagatca

SEQ ID NO: 634 - DNA, 32 bp, synthetic construct
  misc_feature 1..32: note = synthetic oligonucleotide
  source 1..32: mol_type = other DNA
cgacagacgcctgatctgttggaacagcaagt

SEQ ID NO: 635 - DNA, 25 bp, synthetic construct
  misc_feature 1..25: note = synthetic oligonucleotide
  source 1..25: mol_type = other DNA
gatcacttgctgttccaacagatca

SEQ ID NO: 636 - DNA, 32 bp, synthetic construct
  misc_feature 1..32: note = synthetic oligonucleotide
  source 1..32: mol_type = other DNA
cgacagacgcctgatctgttgctctcaacctt

SEQ ID NO: 637 - DNA, 25 bp, synthetic construct
  misc_feature 1..25: note = synthetic oligonucleotide
  source 1..25: mol_type = other DNA
gatcaaggttgagagcaacagatca

SEQ ID NO: 638 - DNA, 32 bp, synthetic construct
  misc_feature 1..32: note = synthetic oligonucleotide
  source 1..32: mol_type = other DNA
cgacagacgcctgatctgttgctcaatctcgt

SEQ ID NO: 639 - DNA, 25 bp, synthetic construct
  misc_feature 1..25: note = synthetic oligonucleotide
  source 1..25: mol_type = other DNA
gatcacgagattgagcaacagatca

SEQ ID NO: 640 - DNA, 32 bp, synthetic construct
  misc_feature 1..32: note = synthetic oligonucleotide
  source 1..32: mol_type = other DNA
cgacagacgcctgatctgttgcaggaaagtct

SEQ ID NO: 641 - DNA, 25 bp, synthetic construct
  misc_feature 1..25: note = synthetic oligonucleotide
  source 1..25: mol_type = other DNA
gatcagactttcctgcaacagatca

SEQ ID NO: 642 - DNA, 32 bp, synthetic construct
  misc_feature 1..32: note = synthetic oligonucleotide
  source 1..32: mol_type = other DNA
cgacagacgcctgatctgttgcaaacctctct

SEQ ID NO: 643 - DNA, 25 bp, synthetic construct
  misc_feature 1..25: note = synthetic oligonucleotide
  source 1..25: mol_type = other DNA
gatcagagaggtttgcaacagatca

SEQ ID NO: 644 - DNA, 32 bp, synthetic construct
  misc_feature 1..32: note = synthetic oligonucleotide
  source 1..32: mol_type = other DNA
cgacagacgcctgatctgttgaatgccgtagt

SEQ ID NO: 645 - DNA, 25 bp, synthetic construct
  misc_feature 1..25: note = synthetic oligonucleotide
  source 1..25: mol_type = other DNA
gatcactacggcattcaacagatca

SEQ ID NO: 646 - DNA, 32 bp, synthetic construct
  misc_feature 1..32: note = synthetic oligonucleotide
  source 1..32: mol_type = other DNA
cgacagacgcctgatctgttctggaggcattt

SEQ ID NO: 647 - DNA, 25 bp, synthetic construct
  misc_feature 1..25: note = synthetic oligonucleotide
  source 1..25: mol_type = other DNA
gatcaaatgcctccagaacagatca

SEQ ID NO: 648 - DNA, 32 bp, synthetic construct
  misc_feature 1..32: note = synthetic oligonucleotide
  source 1..32: mol_type = other DNA
cgacagacgcctgatctgttctgcaacctctt

SEQ ID NO: 649 - DNA, 25 bp, synthetic construct
  misc_feature 1..25: note = synthetic oligonucleotide
  source 1..25: mol_type = other DNA
gatcaagaggttgcagaacagatca

SEQ ID NO: 650 - DNA, 32 bp, synthetic construct
  misc_feature 1..32: note = synthetic oligonucleotide
  source 1..32: mol_type = other DNA
cgacagacgcctgatctgttcgaggaagacat

SEQ ID NO: 651 - DNA, 25 bp, synthetic construct
  misc_feature 1..25: note = synthetic oligonucleotide
  source 1..25: mol_type = other DNA
gatcatgtcttcctcgaacagatca

SEQ ID NO: 652 - DNA, 32 bp, synthetic construct
  misc_feature 1..32: note = synthetic oligonucleotide
  source 1..32: mol_type = other DNA
cgacagacgcctgatctgttcctatcacgctt

SEQ ID NO: 653 - DNA, 25 bp, synthetic construct
  misc_feature 1..25: note = synthetic oligonucleotide
  source 1..25: mol_type = other DNA
gatcaagcgtgataggaacagatca

SEQ ID NO: 654 - DNA, 32 bp, synthetic construct
  misc_feature 1..32: note = synthetic oligonucleotide
  source 1..32: mol_type = other DNA
cgacagacgcctgatctgttccgaaagcaagt

SEQ ID NO: 655 - DNA, 25 bp, synthetic construct
  misc_feature 1..25: note = synthetic oligonucleotide
  source 1..25: mol_type = other DNA
gatcacttgctttcggaacagatca

SEQ ID NO: 656 - DNA, 32 bp, synthetic construct
  misc_feature 1..32: note = synthetic oligonucleotide
  source 1..32: mol_type = other DNA
cgacagacgcctgatctgttcagttccaccat

SEQ ID NO: 657 - DNA, 25 bp, synthetic construct
  misc_feature 1..25: note = synthetic oligonucleotide
  source 1..25: mol_type = other DNA
gatcatggtggaactgaacagatca

SEQ ID NO: 658 - DNA, 32 bp, synthetic construct
  misc_feature 1..32: note = synthetic oligonucleotide
  source 1..32: mol_type = other DNA
cgacagacgcctgatctgttcagagatggcat

SEQ ID NO: 659 - DNA, 25 bp, synthetic construct
  misc_feature 1..25: note = synthetic oligonucleotide
  source 1..25: mol_type = other DNA
gatcatgccatctctgaacagatca

SEQ ID NO: 660 - DNA, 32 bp, synthetic construct
  misc_feature 1..32: note = synthetic oligonucleotide
  source 1..32: mol_type = other DNA
cgacagacgcctgatctgttcacagccaaagt

SEQ ID NO: 661 - DNA, 25 bp, synthetic construct
  misc_feature 1..25: note = synthetic oligonucleotide
  source 1..25: mol_type = other DNA
gatcactttggctgtgaacagatca

SEQ ID NO: 662 - DNA, 32 bp, synthetic construct
  misc_feature 1..32: note = synthetic oligonucleotide
  source 1..32: mol_type = other DNA
cgacagacgcctgatctgttcaaatgcggagt

SEQ ID NO: 663 - DNA, 25 bp, synthetic construct
  misc_feature 1..25: note = synthetic oligonucleotide
  source 1..25: mol_type = other DNA
gatcactccgcatttgaacagatca

SEQ ID NO: 664 - DNA, 32 bp, synthetic construct
  misc_feature 1..32: note = synthetic oligonucleotide
  source 1..32: mol_type = other DNA
cgacagacgcctgatctgttatgaagcaccgt

SEQ ID NO: 665 - DNA, 25 bp, synthetic construct
  misc_feature 1..25: note = synthetic oligonucleotide
  source 1..25: mol_type = other DNA
gatcacggtgcttcataacagatca

SEQ ID NO: 666 - DNA, 32 bp, synthetic construct
  misc_feature 1..32: note = synthetic oligonucleotide
  source 1..32: mol_type = other DNA
cgacagacgcctgatctgttagttgatgccgt

SEQ ID NO: 667 - DNA, 25 bp, synthetic construct
  misc_feature 1..25: note = synthetic oligonucleotide
  source 1..25: mol_type = other DNA
gatcacggcatcaactaacagatca

SEQ ID NO: 668 - DNA, 32 bp, synthetic construct
  misc_feature 1..32: note = synthetic oligonucleotide
  source 1..32: mol_type = other DNA
cgacagacgcctgatctgttagaaagcgcagt

SEQ ID NO: 669 - DNA, 25 bp, synthetic construct
  misc_feature 1..25: note = synthetic oligonucleotide
  source 1..25: mol_type = other DNA
gatcactgcgctttctaacagatca

SEQ ID NO: 670 - DNA, 32 bp, synthetic construct
  misc_feature 1..32: note = synthetic oligonucleotide
  source 1..32: mol_type = other DNA
cgacagacgcctgatctgttacacagctccat

SEQ ID NO: 671 - DNA, 25 bp, synthetic construct
  misc_feature 1..25: note = synthetic oligonucleotide
  source 1..25: mol_type = other DNA
gatcatggagctgtgtaacagatca

SEQ ID NO: 672 - DNA, 32 bp, synthetic construct
  misc_feature 1..32: note = synthetic oligonucleotide
  source 1..32: mol_type = other DNA
cgacagacgcctgatctgtgtcattagcggat

SEQ ID NO: 673 - DNA, 25 bp, synthetic construct
  misc_feature 1..25: note = synthetic oligonucleotide
  source 1..25: mol_type = other DNA
gatcatccgctaatgacacagatca

SEQ ID NO: 674 - DNA, 32 bp, synthetic construct
  misc_feature 1..32: note = synthetic oligonucleotide
  source 1..32: mol_type = other DNA
cgacagacgcctgatctgtgtatgttcgcagt

SEQ ID NO: 675 - DNA, 25 bp, synthetic construct
  misc_feature 1..25: note = synthetic oligonucleotide
  source 1..25: mol_type = other DNA
gatcactgcgaacatacacagatca

SEQ ID NO: 676 - DNA, 32 bp, synthetic construct
  misc_feature 1..32: note = synthetic oligonucleotide
  source 1..32: mol_type = other DNA
cgacagacgcctgatctgtgtataccgccttt

SEQ ID NO: 677 - DNA, 25 bp, synthetic construct
  misc_feature 1..25: note = synthetic oligonucleotide
  source 1..25: mol_type = other DNA
gatcaaaggcggtatacacagatca

SEQ ID NO: 678 - DNA, 32 bp, synthetic construct
  misc_feature 1..32: note = synthetic oligonucleotide
  source 1..32: mol_type = other DNA
cgacagacgcctgatctgtgtaaaccgcatgt

SEQ ID NO: 679 - DNA, 25 bp, synthetic construct
  misc_feature 1..25: note = synthetic oligonucleotide
  source 1..25: mol_type = other DNA
gatcacatgcggtttacacagatca

SEQ ID NO: 680 - DNA, 32 bp, synthetic construct
  misc_feature 1..32: note = synthetic oligonucleotide
  source 1..32: mol_type = other DNA
cgacagacgcctgatctgtggtcaattcgtgt

SEQ ID NO: 681 - DNA, 25 bp, synthetic construct
  misc_feature 1..25: note = synthetic oligonucleotide
  source 1..25: mol_type = other DNA
gatcacacgaattgaccacagatca

SEQ ID NO: 682 - DNA, 32 bp, synthetic construct
  misc_feature 1..32: note = synthetic oligonucleotide
  source 1..32: mol_type = other DNA
cgacagacgcctgatctgtgcttcaaaggtgt

SEQ ID NO: 683 - DNA, 25 bp, synthetic construct
  misc_feature 1..25: note = synthetic oligonucleotide
  source 1..25: mol_type = other DNA
gatcacacctttgaagcacagatca

SEQ ID NO: 684 - DNA, 32 bp, synthetic construct
  misc_feature 1..32: note = synthetic oligonucleotide
  source 1..32: mol_type = other DNA
cgacagacgcctgatctgtgcagaggaaactt

SEQ ID NO: 685 - DNA, 25 bp, synthetic construct
  misc_feature 1..25: note = synthetic oligonucleotide
  source 1..25: mol_type = other DNA
gatcaagtttcctctgcacagatca

SEQ ID NO: 686 - DNA, 32 bp, synthetic construct
  misc_feature 1..32: note = synthetic oligonucleotide
  source 1..32: mol_type = other DNA
cgacagacgcctgatctgtgcaatatcggtgt

SEQ ID NO: 687 - DNA, 25 bp, synthetic construct
  misc_feature 1..25: note = synthetic oligonucleotide
  source 1..25: mol_type = other DNA
gatcacaccgatattgcacagatca

SEQ ID NO: 688 - DNA, 32 bp, synthetic construct
  misc_feature 1..32: note = synthetic oligonucleotide
  source 1..32: mol_type = other DNA
cgacagacgcctgatctgtgaggttccagttt

SEQ ID NO: 689 - DNA, 25 bp, synthetic construct
  misc_feature 1..25: note = synthetic oligonucleotide
  source 1..25: mol_type = other DNA
gatcaaactggaacctcacagatca

SEQ ID NO: 690 - DNA, 32 bp, synthetic construct
  misc_feature 1..32: note = synthetic oligonucleotide
  source 1..32: mol_type = other DNA
cgacagacgcctgatctgtgaattccttgcgt

SEQ ID NO: 691 - DNA, 25 bp, synthetic construct
  misc_feature 1..25: note = synthetic oligonucleotide
  source 1..25: mol_type = other DNA
gatcacgcaaggaattcacagatca

SEQ ID NO: 692 - DNA, 32 bp, synthetic construct
  misc_feature 1..32: note = synthetic oligonucleotide
  source 1..32: mol_type = other DNA
cgacagacgcctgatctgtgaagtaagccgat

SEQ ID NO: 693 - DNA, 25 bp, synthetic construct
  misc_feature 1..25: note = synthetic oligonucleotide
  source 1..25: mol_type = other DNA
gatcatcggcttacttcacagatca

SEQ ID NO: 694 - DNA, 32 bp, synthetic construct
  misc_feature 1..32: note = synthetic oligonucleotide
  source 1..32: mol_type = other DNA
cgacagacgcctgatctgtctttgaacgtggt

SEQ ID NO: 695 - DNA, 25 bp, synthetic construct
  misc_feature 1..25: note = synthetic oligonucleotide
  source 1..25: mol_type = other DNA
gatcaccacgttcaaagacagatca

SEQ ID NO: 696 - DNA, 32 bp, synthetic construct
  misc_feature 1..32: note = synthetic oligonucleotide
  source 1..32: mol_type = other DNA
cgacagacgcctgatctgtctgaaaccaccat

SEQ ID NO: 697 - DNA, 25 bp, synthetic construct
  misc_feature 1..25: note = synthetic oligonucleotide
  source 1..25: mol_type = other DNA
gatcatggtggtttcagacagatca

SEQ ID NO: 698 - DNA, 32 bp, synthetic construct
  misc_feature 1..32: note = synthetic oligonucleotide
  source 1..32: mol_type = other DNA
cgacagacgcctgatctgtctcgaaacctgtt

SEQ ID NO: 699 - DNA, 25 bp, synthetic construct
  misc_feature 1..25: note = synthetic oligonucleotide
  source 1..25: mol_type = other DNA
gatcaacaggtttcgagacagatca

SEQ ID NO: 700 - DNA, 32 bp, synthetic construct
  misc_feature 1..32: note = synthetic oligonucleotide
  source 1..32: mol_type = other DNA
cgacagacgcctgatctgtcgtaagaggcaat

SEQ ID NO: 701 - DNA, 25 bp, synthetic construct
  misc_feature 1..25: note = synthetic oligonucleotide
  source 1..25: mol_type = other DNA
gatcattgcctcttacgacagatca

SEQ ID NO: 702 - DNA, 32 bp, synthetic construct
  misc_feature 1..32: note = synthetic oligonucleotide
  source 1..32: mol_type = other DNA
cgacagacgcctgatctgtcgaaacttggtgt

SEQ ID NO: 703 - DNA, 25 bp, synthetic construct
  misc_feature 1..25: note = synthetic oligonucleotide
  source 1..25: mol_type = other DNA
gatcacaccaagtttcgacagatca

SEQ ID NO: 704 - DNA, 32 bp, synthetic construct
  misc_feature 1..32: note = synthetic oligonucleotide
  source 1..32: mol_type = other DNA
cgacagacgcctgatctgtcctatgttgccat

SEQ ID NO: 705 - DNA, 25 bp, synthetic construct
  misc_feature 1..25: note = synthetic oligonucleotide
  source 1..25: mol_type = other DNA
gatcatggcaacataggacagatca

SEQ ID NO: 706 - DNA, 32 bp, synthetic construct
  misc_feature 1..32: note = synthetic oligonucleotide
  source 1..32: mol_type = other DNA
cgacagacgcctgatctgtccacctaaacgat

SEQ ID NO: 707 - DNA, 25 bp, synthetic construct
  misc_feature 1..25: note = synthetic oligonucleotide
  source 1..25: mol_type = other DNA
gatcatcgtttaggtggacagatca

SEQ ID NO: 708 - DNA, 32 bp, synthetic construct
  misc_feature 1..32: note = synthetic oligonucleotide
  source 1..32: mol_type = other DNA
cgacagacgcctgatctgtccaaatcacagct

SEQ ID NO: 709 - DNA, 25 bp, synthetic construct
  misc_feature 1..25: note = synthetic oligonucleotide
  source 1..25: mol_type = other DNA
gatcagctgtgatttggacagatca

SEQ ID NO: 710 - DNA, 32 bp, synthetic construct
  misc_feature 1..32: note = synthetic oligonucleotide
  source 1..32: mol_type = other DNA
cgacagacgcctgatctgtccaaagctaccat

SEQ ID NO: 711 - DNA, 25 bp, synthetic construct
  misc_feature 1..25: note = synthetic oligonucleotide
  source 1..25: mol_type = other DNA
gatcatggtagctttggacagatca

SEQ ID NO: 712 - DNA, 32 bp, synthetic construct
  misc_feature 1..32: note = synthetic oligonucleotide
  source 1..32: mol_type = other DNA
cgacagacgcctgatctgtcactttgcatcct

SEQ ID NO: 713 - DNA, 25 bp, synthetic construct
  misc_feature 1..25: note = synthetic oligonucleotide
  source 1..25: mol_type = other DNA
gatcaggatgcaaagtgacagatca

SEQ ID NO: 714 - DNA, 32 bp, synthetic construct
  misc_feature 1..32: note = synthetic oligonucleotide
  source 1..32: mol_type = other DNA
cgacagacgcctgatctgtcaaacagccatct

SEQ ID NO: 715 - DNA, 25 bp, synthetic construct
  misc_feature 1..25: note = synthetic oligonucleotide
  source 1..25: mol_type = other DNA
gatcagatggctgtttgacagatca

SEQ ID NO: 716 - DNA, 32 bp, synthetic construct
  misc_feature 1..32: note = synthetic oligonucleotide
  source 1..32: mol_type = other DNA
cgacagacgcctgatctgtatttggacacgct

SEQ ID NO: 717 - DNA, 25 bp, synthetic construct
  misc_feature 1..25: note = synthetic oligonucleotide
  source 1..25: mol_type = other DNA
gatcagcgtgtccaaatacagatca

SEQ ID NO: 718 - DNA, 32 bp, synthetic construct
  misc_feature 1..32: note = synthetic oligonucleotide
  source 1..32: mol_type = other DNA
cgacagacgcctgatctgtatttccgaccgtt

SEQ ID NO: 719 - DNA, 25 bp, synthetic construct
  misc_feature 1..25: note = synthetic oligonucleotide
  source 1..25: mol_type = other DNA
gatcaacggtcggaaatacagatca

SEQ ID NO: 720 - DNA, 32 bp, synthetic construct
  misc_feature 1..32: note = synthetic oligonucleotide
  source 1..32: mol_type = other DNA
cgacagacgcctgatctgtattgacgcttggt

SEQ ID NO: 721 - DNA, 25 bp, synthetic construct
  misc_feature 1..25: note = synthetic oligonucleotide
  source 1..25: mol_type = other DNA
gatcaccaagcgtcaatacagatca

SEQ ID NO: 722 - DNA, 32 bp, synthetic construct
  misc_feature 1..32: note = synthetic oligonucleotide
  source 1..32: mol_type = other DNA
cgacagacgcctgatctgtatacgcaaaccgt

SEQ ID NO: 723 - DNA, 25 bp, synthetic construct
  misc_feature 1..25: note = synthetic oligonucleotide
  source 1..25: mol_type = other DNA
gatcacggtttgcgtatacagatca

SEQ ID NO: 724 - DNA, 32 bp, synthetic construct
  misc_feature 1..32: note = synthetic oligonucleotide
  source 1..32: mol_type = other DNA
cgacagacgcctgatctgtataacgccaccat

SEQ ID NO: 725 - DNA, 25 bp, synthetic construct
  misc_feature 1..25: note = synthetic oligonucleotide
  source 1..25: mol_type = other DNA
gatcatggtggcgttatacagatca

SEQ ID NO: 726 - DNA, 32 bp, synthetic construct
  misc_feature 1..32: note = synthetic oligonucleotide
  source 1..32: mol_type = other DNA
cgacagacgcctgatctgtagtgtcaaagcgt

SEQ ID NO: 727 - DNA, 25 bp, synthetic construct
  misc_feature 1..25: note = synthetic oligonucleotide
  source 1..25: mol_type = other DNA
gatcacgctttgacactacagatca

SEQ ID NO: 728 - DNA, 32 bp, synthetic construct
  misc_feature 1..32: note = synthetic oligonucleotide
  source 1..32: mol_type = other DNA
cgacagacgcctgatctgtaggcggatttctt

SEQ ID NO: 729 - DNA, 25 bp, synthetic construct
  misc_feature 1..25: note = synthetic oligonucleotide
  source 1..25: mol_type = other DNA
gatcaagaaatccgcctacagatca

SEQ ID NO: 730 - DNA, 32 bp, synthetic construct
  misc_feature 1..32: note = synthetic oligonucleotide
  source 1..32: mol_type = other DNA
cgacagacgcctgatctgtaggcaaacggtat

SEQ ID NO: 731 - DNA, 25 bp, synthetic construct
  misc_feature 1..25: note = synthetic oligonucleotide
  source 1..25: mol_type = other DNA
gatcataccgtttgcctacagatca

SEQ ID NO: 732 - DNA, 32 bp, synthetic construct
  misc_feature 1..32: note = synthetic oligonucleotide
  source 1..32: mol_type = other DNA
cgacagacgcctgatctgtacgtcctttccat

SEQ ID NO: 733 - DNA, 25 bp, synthetic construct
  misc_feature 1..25: note = synthetic oligonucleotide
  source 1..25: mol_type = other DNA
gatcatggaaaggacgtacagatca

SEQ ID NO: 734 - DNA, 32 bp, synthetic construct
  misc_feature 1..32: note = synthetic oligonucleotide
  source 1..32: mol_type = other DNA
cgacagacgcctgatctgtaccacacgcttat

SEQ ID NO: 735 - DNA, 25 bp, synthetic construct
  misc_feature 1..25: note = synthetic oligonucleotide
  source 1..25: mol_type = other DNA
gatcataagcgtgtggtacagatca

SEQ ID NO: 736 - DNA, 32 bp, synthetic construct
  misc_feature 1..32: note = synthetic oligonucleotide
  source 1..32: mol_type = other DNA
cgacagacgcctgatctgtaatgttgtccgct

SEQ ID NO: 737 - DNA, 25 bp, synthetic construct
  misc_feature 1..25: note = synthetic oligonucleotide
  source 1..25: mol_type = other DNA
gatcagcggacaacattacagatca

SEQ ID NO: 738 - DNA, 32 bp, synthetic construct
  misc_feature 1..32: note = synthetic oligonucleotide
  source 1..32: mol_type = other DNA
cgacagacgcctgatctgtaatccgagccatt

SEQ ID NO: 739 - DNA, 25 bp, synthetic construct
  misc_feature 1..25: note = synthetic oligonucleotide
  source 1..25: mol_type = other DNA
gatcaatggctcggattacagatca

SEQ ID NO: 740 - DNA, 32 bp, synthetic construct
  misc_feature 1..32: note = synthetic oligonucleotide
  source 1..32: mol_type = other DNA
cgacagacgcctgatctgtaagttccgcatgt

SEQ ID NO: 741 - DNA, 25 bp, synthetic construct
  misc_feature 1..25: note = synthetic oligonucleotide
  source 1..25: mol_type = other DNA
gatcacatgcggaacttacagatca

SEQ ID NO: 742 - DNA, 32 bp, synthetic construct
  misc_feature 1..32: note = synthetic oligonucleotide
  source 1..32: mol_type = other DNA
cgacagacgcctgatctgtaagtccgttggtt

SEQ ID NO: 743 - DNA, 25 bp, synthetic construct
  misc_feature 1..25: note = synthetic oligonucleotide
  source 1..25: mol_type = other DNA
gatcaaccaacggacttacagatca

SEQ ID NO: 744 - DNA, 32 bp, synthetic construct
  misc_feature 1..32: note = synthetic oligonucleotide
  source 1..32: mol_type = other DNA
cgacagacgcctgatctgtaacgtttgctggt

SEQ ID NO: 745 - DNA, 25 bp, synthetic construct
  misc_feature 1..25: note = synthetic oligonucleotide
  source 1..25: mol_type = other DNA
gatcaccagcaaacgttacagatca

SEQ ID NO: 746 - DNA, 32 bp, synthetic construct
  misc_feature 1..32: note = synthetic oligonucleotide
  source 1..32: mol_type = other DNA
cgacagacgcctgatctgtaaattggcacggt

SEQ ID NO: 747 - DNA, 25 bp, synthetic construct
  misc_feature 1..25: note = synthetic oligonucleotide
  source 1..25: mol_type = other DNA
gatcaccgtgccaatttacagatca

SEQ ID NO: 748 - DNA, 32 bp, synthetic construct
  misc_feature 1..32: note = synthetic oligonucleotide
  source 1..32: mol_type = other DNA
cgacagacgcctgatctgtaaacgatggcagt

SEQ ID NO: 749 - DNA, 25 bp, synthetic construct
  misc_feature 1..25: note = synthetic oligonucleotide
  source 1..25: mol_type = other DNA
gatcactgccatcgtttacagatca

SEQ ID NO: 750 - DNA, 32 bp, synthetic construct
  misc_feature 1..32: note = synthetic oligonucleotide
  source 1..32: mol_type = other DNA
cgacagacgcctgatctggtttcaatgtcggt

SEQ ID NO: 751 - DNA, 25 bp, synthetic construct
  misc_feature 1..25: note = synthetic oligonucleotide
  source 1..25: mol_type = other DNA
gatcaccgacattgaaaccagatca

SEQ ID NO: 752 - DNA, 32 bp, synthetic construct
  misc_feature 1..32: note = synthetic oligonucleotide
  source 1..32: mol_type = other DNA
cgacagacgcctgatctggttgatgacctgtt

SEQ ID NO: 753 - DNA, 25 bp, synthetic construct
  misc_feature 1..25: note = synthetic oligonucleotide
  source 1..25: mol_type = other DNA
gatcaacaggtcatcaaccagatca

SEQ ID NO: 754 - DNA, 32 bp, synthetic construct
  misc_feature 1..32: note = synthetic oligonucleotide
  source 1..32: mol_type = other DNA
cgacagacgcctgatctggttgaccgaaagat

SEQ ID NO: 755 - DNA, 25 bp, synthetic construct
  misc_feature 1..25: note = synthetic oligonucleotide
  source 1..25: mol_type = other DNA
gatcatctttcggtcaaccagatca

SEQ ID NO: 756 - DNA, 32 bp, synthetic construct
  misc_feature 1..32: note = synthetic oligonucleotide
  source 1..32: mol_type = other DNA
cgacagacgcctgatctggttcttccaccaat

SEQ ID NO: 757 - DNA, 25 bp, synthetic construct
  misc_feature 1..25: note = synthetic oligonucleotide
  source 1..25: mol_type = other DNA
gatcattggtggaagaaccagatca

SEQ ID NO: 758 - DNA, 32 bp, synthetic construct
  misc_feature 1..32: note = synthetic oligonucleotide
  source 1..32: mol_type = other DNA
cgacagacgcctgatctggttcttaccacgtt

SEQ ID NO: 759 - DNA, 25 bp, synthetic construct
  misc_feature 1..25: note = synthetic oligonucleotide
  source 1..25: mol_type = other DNA
gatcaacgtggtaagaaccagatca

SEQ ID NO: 760 - DNA, 32 bp, synthetic construct
  misc_feature 1..32: note = synthetic oligonucleotide
  source 1..32: mol_type = other DNA
cgacagacgcctgatctggttctattgccgat

SEQ ID NO: 761 - DNA, 25 bp, synthetic construct
  misc_feature 1..25: note = synthetic oligonucleotide
  source 1..25: mol_type = other DNA
gatcatcggcaatagaaccagatca

SEQ ID NO: 762 - DNA, 32 bp, synthetic construct
  misc_feature 1..32: note = synthetic oligonucleotide
  source 1..32: mol_type = other DNA
cgacagacgcctgatctggttccaatcacgat

SEQ ID NO: 763 - DNA, 25 bp, synthetic construct
  misc_feature 1..25: note = synthetic oligonucleotide
  source 1..25: mol_type = other DNA
gatcatcgtgattggaaccagatca

SEQ ID NO: 764 - DNA, 32 bp, synthetic construct
  misc_feature 1..32: note = synthetic oligonucleotide
  source 1..32: mol_type = other DNA
cgacagacgcctgatctggttcaacattcggt

SEQ ID NO: 765 - DNA, 25 bp, synthetic construct
  misc_feature 1..25: note = synthetic oligonucleotide
  source 1..25: mol_type = other DNA
gatcaccgaatgttgaaccagatca

SEQ ID NO: 766 - DNA, 32 bp, synthetic construct
  misc_feature 1..32: note = synthetic oligonucleotide
  source 1..32: mol_type = other DNA
cgacagacgcctgatctggttaaagccgagat

SEQ ID NO: 767 - DNA, 25 bp, synthetic construct
  misc_feature 1..25: note = synthetic oligonucleotide
  source 1..25: mol_type = other DNA
gatcatctcggctttaaccagatca

SEQ ID NO: 768 - DNA, 32 bp, synthetic construct
  misc_feature 1..32: note = synthetic oligonucleotide
  source 1..32: mol_type = other DNA
cgacagacgcctgatctggtgttaccgatgtt

SEQ ID NO: 769 - DNA, 25 bp, synthetic construct
  misc_feature 1..25: note = synthetic oligonucleotide
  source 1..25: mol_type = other DNA
gatcaacatcggtaacaccagatca

SEQ ID NO: 770 - DNA, 32 bp, synthetic construct
  misc_feature 1..32: note = synthetic oligonucleotide
  source 1..32: mol_type = other DNA
cgacagacgcctgatctggtgaaccaaatgct

SEQ ID NO: 771 - DNA, 25 bp, synthetic construct
  misc_feature 1..25: note = synthetic oligonucleotide
  source 1..25: mol_type = other DNA
gatcagcatttggttcaccagatca

SEQ ID NO: 772 - DNA, 32 bp, synthetic construct
  misc_feature 1..32: note = synthetic oligonucleotide
  source 1..32: mol_type = other DNA
cgacagacgcctgatctggtgaaatcgcaagt

SEQ ID NO: 773 - DNA, 25 bp, synthetic construct
  misc_feature 1..25: note = synthetic oligonucleotide
  source 1..25: mol_type = other DNA
gatcacttgcgatttcaccagatca

SEQ ID NO: 774 - DNA, 32 bp, synthetic construct
  misc_feature 1..32: note = synthetic oligonucleotide
  source 1..32: mol_type = other DNA
cgacagacgcctgatctggtccaattctcgtt

SEQ ID NO: 775 - DNA, 25 bp, synthetic construct
  misc_feature 1..25: note = synthetic oligonucleotide
  source 1..25: mol_type = other DNA
gatcaacgagaattggaccagatca

SEQ ID NO: 776 - DNA, 32 bp, synthetic construct
  misc_feature 1..32: note = synthetic oligonucleotide
  source 1..32: mol_type = other DNA
cgacagacgcctgatctggtcacaaacacctt

SEQ ID NO: 777 - DNA, 25 bp, synthetic construct
  misc_feature 1..25: note = synthetic oligonucleotide
  source 1..25: mol_type = other DNA
gatcaaggtgtttgtgaccagatca

SEQ ID NO: 778 - DNA, 32 bp, synthetic construct
  misc_feature 1..32: note = synthetic oligonucleotide
  source 1..32: mol_type = other DNA
cgacagacgcctgatctggtataacgagcgat

SEQ ID NO: 779 - DNA, 25 bp, synthetic construct
  misc_feature 1..25: note = synthetic oligonucleotide
  source 1..25: mol_type = other DNA
gatcatcgctcgttataccagatca

SEQ ID NO: 780 - DNA, 32 bp, synthetic construct
  misc_feature 1..32: note = synthetic oligonucleotide
  source 1..32: mol_type = other DNA
cgacagacgcctgatctggtaggtttcagcat

SEQ ID NO: 781 - DNA, 25 bp, synthetic construct
  misc_feature 1..25: note = synthetic oligonucleotide
  source 1..25: mol_type = other DNA
gatcatgctgaaacctaccagatca

SEQ ID NO: 782 - DNA, 32 bp, synthetic construct
  misc_feature 1..32: note = synthetic oligonucleotide
  source 1..32: mol_type = other DNA
cgacagacgcctgatctggtactccaaacgat

SEQ ID NO: 783 - DNA, 25 bp, synthetic construct
  misc_feature 1..25: note = synthetic oligonucleotide
  source 1..25: mol_type = other DNA
gatcatcgtttggagtaccagatca

SEQ ID NO: 784 - DNA, 32 bp, synthetic construct
  misc_feature 1..32: note = synthetic oligonucleotide
  source 1..32: mol_type = other DNA
cgacagacgcctgatctggtacacaaatcgct

SEQ ID NO: 785 - DNA, 25 bp, synthetic construct
  misc_feature 1..25: note = synthetic oligonucleotide
  source 1..25: mol_type = other DNA
gatcagcgatttgtgtaccagatca

SEQ ID NO: 786 - DNA, 32 bp, synthetic construct
  misc_feature 1..32: note = synthetic oligonucleotide
  source 1..32: mol_type = other DNA
cgacagacgcctgatctggtacaaacactgct

SEQ ID NO: 787 - DNA, 25 bp, synthetic construct
  misc_feature 1..25: note = synthetic oligonucleotide
  source 1..25: mol_type = other DNA
gatcagcagtgtttgtaccagatca

SEQ ID NO: 788 - DNA, 32 bp, synthetic construct
  misc_feature 1..32: note = synthetic oligonucleotide
  source 1..32: mol_type = other DNA
cgacagacgcctgatctggtaagacgcaatgt

SEQ ID NO: 789 - DNA, 25 bp, synthetic construct
  misc_feature 1..25: note = synthetic oligonucleotide
  source 1..25: mol_type = other DNA
gatcacattgcgtcttaccagatca

SEQ ID NO: 790 - DNA, 32 bp, synthetic construct
  misc_feature 1..32: note = synthetic oligonucleotide
  source 1..32: mol_type = other DNA
cgacagacgcctgatctggtaaatgcaacggt

SEQ ID NO: 791 - DNA, 25 bp, synthetic construct
  misc_feature 1..25: note = synthetic oligonucleotide
  source 1..25: mol_type = other DNA
gatcaccgttgcatttaccagatca

SEQ ID NO: 792 - DNA, 32 bp, synthetic construct
  misc_feature 1..32: note = synthetic oligonucleotide
  source 1..32: mol_type = other DNA
cgacagacgcctgatctggtaaagcacatcgt

SEQ ID NO: 793 - DNA, 25 bp, synthetic construct
  misc_feature 1..25: note = synthetic oligonucleotide
  source 1..25: mol_type = other DNA
gatcacgatgtgctttaccagatca

SEQ ID NO: 794 - DNA, 32 bp, synthetic construct
  misc_feature 1..32: note = synthetic oligonucleotide
  source 1..32: mol_type = other DNA
cgacagacgcctgatctggcttcctaaacgtt

SEQ ID NO: 795 - DNA, 25 bp, synthetic construct
  misc_feature 1..25: note = synthetic oligonucleotide
  source 1..25: mol_type = other DNA
gatcaacgtttaggaagccagatca

SEQ ID NO: 796 - DNA, 32 bp, synthetic construct
  misc_feature 1..32: note = synthetic oligonucleotide
  source 1..32: mol_type = other DNA
cgacagacgcctgatctggctaaatgacgtgt

SEQ ID NO: 797 - DNA, 25 bp, synthetic construct
  misc_feature 1..25: note = synthetic oligonucleotide
  source 1..25: mol_type = other DNA
gatcacacgtcatttagccagatca

SEQ ID NO: 798 - DNA, 32 bp, synthetic construct
  misc_feature 1..32: note = synthetic oligonucleotide
  source 1..32: mol_type = other DNA
cgacagacgcctgatctggctaaacacctcat

SEQ ID NO: 799 - DNA, 25 bp, synthetic construct
  misc_feature 1..25: note = synthetic oligonucleotide
  source 1..25: mol_type = other DNA
gatcatgaggtgtttagccagatca

SEQ ID NO: 800 - DNA, 32 bp, synthetic construct
  misc_feature 1..32: note = synthetic oligonucleotide
  source 1..32: mol_type = other DNA
cgacagacgcctgatctggcctcaaataccat

SEQ ID NO: 801 - DNA, 25 bp, synthetic construct
  misc_feature 1..25: note = synthetic oligonucleotide
  source 1..25: mol_type = other DNA
gatcatggtatttgaggccagatca

SEQ ID NO: 802 - DNA, 32 bp, synthetic construct
  misc_feature 1..32: note = synthetic oligonucleotide
  source 1..32: mol_type = other DNA
cgacagacgcctgatctggcatttcaaccagt

SEQ ID NO: 803 - DNA, 25 bp, synthetic construct
  misc_feature 1..25: note = synthetic oligonucleotide
  source 1..25: mol_type = other DNA
gatcactggttgaaatgccagatca

SEQ ID NO: 804 - DNA, 32 bp, synthetic construct
  misc_feature 1..32: note = synthetic oligonucleotide
  source 1..32: mol_type = other DNA
cgacagacgcctgatctggcacaagaggattt

SEQ ID NO: 805 - DNA, 25 bp, synthetic construct
  misc_feature 1..25: note = synthetic oligonucleotide
  source 1..25: mol_type = other DNA
gatcaaatcctcttgtgccagatca

SEQ ID NO: 806 - DNA, 32 bp, synthetic construct
  misc_feature 1..32: note = synthetic oligonucleotide
  source 1..32: mol_type = other DNA
cgacagacgcctgatctggcaatttgacaggt

SEQ ID NO: 807 - DNA, 25 bp, synthetic construct
  misc_feature 1..25: note = synthetic oligonucleotide
  source 1..25: mol_type = other DNA
gatcacctgtcaaattgccagatca

SEQ ID NO: 808 - DNA, 32 bp, synthetic construct
  misc_feature 1..32: note = synthetic oligonucleotide
  source 1..32: mol_type = other DNA
cgacagacgcctgatctggcaacttcatcctt

SEQ ID NO: 809 - DNA, 25 bp, synthetic construct
  misc_feature 1..25: note = synthetic oligonucleotide
  source 1..25: mol_type = other DNA
gatcaaggatgaagttgccagatca

SEQ ID NO: 810 - DNA, 32 bp, synthetic construct
  misc_feature 1..32: note = synthetic oligonucleotide
  source 1..32: mol_type = other DNA
cgacagacgcctgatctggcaacaatccatct

SEQ ID NO: 811 - DNA, 25 bp, synthetic construct
  misc_feature 1..25: note = synthetic oligonucleotide
  source 1..25: mol_type = other DNA
gatcagatggattgttgccagatca

SEQ ID NO: 812 - DNA, 32 bp, synthetic construct
  misc_feature 1..32: note = synthetic oligonucleotide
  source 1..32: mol_type = other DNA
cgacagacgcctgatctggatttcatgtgcgt

SEQ ID NO: 813 - DNA, 25 bp, synthetic construct
  misc_feature 1..25: note = synthetic oligonucleotide
  source 1..25: mol_type = other DNA
gatcacgcacatgaaatccagatca

SEQ ID NO: 814 - DNA, 32 bp, synthetic construct
  misc_feature 1..32: note = synthetic oligonucleotide
  source 1..32: mol_type = other DNA
cgacagacgcctgatctggattgtttcacggt

SEQ ID NO: 815 - DNA, 25 bp, synthetic construct
  misc_feature 1..25: note = synthetic oligonucleotide
  source 1..25: mol_type = other DNA
gatcaccgtgaaacaatccagatca

SEQ ID NO: 816 - DNA, 32 bp, synthetic construct
  misc_feature 1..32: note = synthetic oligonucleotide
  source 1..32: mol_type = other DNA
cgacagacgcctgatctggattgtcactggtt

SEQ ID NO: 817 - DNA, 25 bp, synthetic construct
  misc_feature 1..25: note = synthetic oligonucleotide
  source 1..25: mol_type = other DNA
gatcaaccagtgacaatccagatca

SEQ ID NO: 818 - DNA, 32 bp, synthetic construct
  misc_feature 1..32: note = synthetic oligonucleotide
  source 1..32: mol_type = other DNA
cgacagacgcctgatctggattagctccgttt

SEQ ID NO: 819 - DNA, 25 bp, synthetic construct
  misc_feature 1..25: note = synthetic oligonucleotide
  source 1..25: mol_type = other DNA
gatcaaacggagctaatccagatca

SEQ ID NO: 820 - DNA, 32 bp, synthetic construct
  misc_feature 1..32: note = synthetic oligonucleotide
  source 1..32: mol_type = other DNA
cgacagacgcctgatctggatgtttacgctgt

SEQ ID NO: 821 - DNA, 25 bp, synthetic construct
  misc_feature 1..25: note = synthetic oligonucleotide
  source 1..25: mol_type = other DNA
gatcacagcgtaaacatccagatca

SEQ ID NO: 822 - DNA, 32 bp, synthetic construct
  misc_feature 1..32: note = synthetic oligonucleotide
  source 1..32: mol_type = other DNA
cgacagacgcctgatctggatcacaacatgct

SEQ ID NO: 823 - DNA, 25 bp, synthetic construct
  misc_feature 1..25: note = synthetic oligonucleotide
  source 1..25: mol_type = other DNA
gatcagcatgttgtgatccagatca

SEQ ID NO: 824 - DNA, 32 bp, synthetic construct
  misc_feature 1..32: note = synthetic oligonucleotide
  source 1..32: mol_type = other DNA
cgacagacgcctgatctggagttacggctttt

SEQ ID NO: 825 - DNA, 25 bp, synthetic construct
  misc_feature 1..25: note = synthetic oligonucleotide
  source 1..25: mol_type = other DNA
gatcaaaagccgtaactccagatca

SEQ ID NO: 826 - DNA, 32 bp, synthetic construct
  misc_feature 1..32: note = synthetic oligonucleotide
  source 1..32: mol_type = other DNA
cgacagacgcctgatctggaggacttcgtttt

SEQ ID NO: 827 - DNA, 25 bp, synthetic construct
  misc_feature 1..25: note = synthetic oligonucleotide
  source 1..25: mol_type = other DNA
gatcaaaacgaagtcctccagatca

SEQ ID NO: 828 - DNA, 32 bp, synthetic construct
  misc_feature 1..32: note = synthetic oligonucleotide
  source 1..32: mol_type = other DNA
cgacagacgcctgatctggactccacacaatt

SEQ ID NO: 829 - DNA, 25 bp, synthetic construct
  misc_feature 1..25: note = synthetic oligonucleotide
  source 1..25: mol_type = other DNA
gatcaattgtgtggagtccagatca

SEQ ID NO: 830 - DNA, 32 bp, synthetic construct
  misc_feature 1..32: note = synthetic oligonucleotide
  source 1..32: mol_type = other DNA
cgacagacgcctgatctggactattctgcgtt

SEQ ID NO: 831 - DNA, 25 bp, synthetic construct
  misc_feature 1..25: note = synthetic oligonucleotide
  source 1..25: mol_type = other DNA
gatcaacgcagaatagtccagatca

SEQ ID NO: 832 - DNA, 32 bp, synthetic construct
  misc_feature 1..32: note = synthetic oligonucleotide
  source 1..32: mol_type = other DNA
cgacagacgcctgatctggacaccatttcgat

SEQ ID NO: 833 - DNA, 25 bp, synthetic construct
  misc_feature 1..25: note = synthetic oligonucleotide
  source 1..25: mol_type = other DNA
gatcatcgaaatggtgtccagatca

SEQ ID NO: 834 - DNA, 32 bp, synthetic construct
  misc_feature 1..32: note = synthetic oligonucleotide
  source 1..32: mol_type = other DNA
cgacagacgcctgatctggacaatcaccagtt

SEQ ID NO: 835 - DNA, 25 bp, synthetic construct
  misc_feature 1..25: note = synthetic oligonucleotide
  source 1..25: mol_type = other DNA
gatcaactggtgattgtccagatca

SEQ ID NO: 836 - DNA, 32 bp, synthetic construct
  misc_feature 1..32: note = synthetic oligonucleotide
  source 1..32: mol_type = other DNA
cgacagacgcctgatctggaattgtgccttgt

SEQ ID NO: 837 - DNA, 25 bp, synthetic construct
  misc_feature 1..25: note = synthetic oligonucleotide
  source 1..25: mol_type = other DNA
gatcacaaggcacaattccagatca

SEQ ID NO: 838 - DNA, 32 bp, synthetic construct
  misc_feature 1..32: note = synthetic oligonucleotide
  source 1..32: mol_type = other DNA
cgacagacgcctgatctggaattgtacgcagt

SEQ ID NO: 839 - DNA, 25 bp, synthetic construct
  misc_feature 1..25: note = synthetic oligonucleotide
  source 1..25: mol_type = other DNA
gatcactgcgtacaattccagatca

SEQ ID NO: 840 - DNA, 32 bp, synthetic construct
  misc_feature 1..32: note = synthetic oligonucleotide
  source 1..32: mol_type = other DNA
cgacagacgcctgatctggaatgcaaactggt

SEQ ID NO: 841 - DNA, 25 bp, synthetic construct
  misc_feature 1..25: note = synthetic oligonucleotide
  source 1..25: mol_type = other DNA
gatcaccagtttgcattccagatca

SEQ ID NO: 842 - DNA, 32 bp, synthetic construct
  misc_feature 1..32: note = synthetic oligonucleotide
  source 1..32: mol_type = other DNA
cgacagacgcctgatctggaagatgccgttat

SEQ ID NO: 843 - DNA, 25 bp, synthetic construct
  misc_feature 1..25: note = synthetic oligonucleotide
  source 1..25: mol_type = other DNA
gatcataacggcatcttccagatca

SEQ ID NO: 844 - DNA, 32 bp, synthetic construct
  misc_feature 1..32: note = synthetic oligonucleotide
  source 1..32: mol_type = other DNA
cgacagacgcctgatctggaacatcagccttt

SEQ ID NO: 845 - DNA, 25 bp, synthetic construct
  misc_feature 1..25: note = synthetic oligonucleotide
  source 1..25: mol_type = other DNA
gatcaaaggctgatgttccagatca

SEQ ID NO: 846 - DNA, 32 bp, synthetic construct
  misc_feature 1..32: note = synthetic oligonucleotide
  source 1..32: mol_type = other DNA
cgacagacgcctgatctggaacatagagcgtt

SEQ ID NO: 847 - DNA, 25 bp, synthetic construct
  misc_feature 1..25: note = synthetic oligonucleotide
  source 1..25: mol_type = other DNA
gatcaacgctctatgttccagatca

SEQ ID NO: 848 - DNA, 32 bp, synthetic construct
  misc_feature 1..32: note = synthetic oligonucleotide
  source 1..32: mol_type = other DNA
cgacagacgcctgatctggaaactaaggcgtt

SEQ ID NO: 849 - DNA, 25 bp, synthetic construct
  misc_feature 1..25: note = synthetic oligonucleotide
  source 1..25: mol_type = other DNA
gatcaacgccttagtttccagatca

SEQ ID NO: 850 - DNA, 32 bp, synthetic construct
  misc_feature 1..32: note = synthetic oligonucleotide
  source 1..32: mol_type = other DNA
cgacagacgcctgatctggaaacaccttggat

SEQ ID NO: 851 - DNA, 25 bp, synthetic construct
  misc_feature 1..25: note = synthetic oligonucleotide
  source 1..25: mol_type = other DNA
gatcatccaaggtgtttccagatca

SEQ ID NO: 852 - DNA, 32 bp, synthetic construct
  misc_feature 1..32: note = synthetic oligonucleotide
  source 1..32: mol_type = other DNA
cgacagacgcctgatctgctttcacacttcgt

SEQ ID NO: 853 - DNA, 25 bp, synthetic construct
  misc_feature 1..25: note = synthetic oligonucleotide
  source 1..25: mol_type = other DNA
gatcacgaagtgtgaaagcagatca

SEQ ID NO: 854 - DNA, 32 bp, synthetic construct
  misc_feature 1..32: note = synthetic oligonucleotide
  source 1..32: mol_type = other DNA
cgacagacgcctgatctgctttaatgcgaggt

SEQ ID NO: 855 - DNA, 25 bp, synthetic construct
  misc_feature 1..25: note = synthetic oligonucleotide
  source 1..25: mol_type = other DNA
gatcacctcgcattaaagcagatca

SEQ ID NO: 856 - DNA, 32 bp, synthetic construct
  misc_feature 1..32: note = synthetic oligonucleotide
  source 1..32: mol_type = other DNA
cgacagacgcctgatctgcttgaaccatcctt

SEQ ID NO: 857 - DNA, 25 bp, synthetic construct
  misc_feature 1..25: note = synthetic oligonucleotide
  source 1..25: mol_type = other DNA
gatcaaggatggttcaagcagatca

SEQ ID NO: 858 - DNA, 32 bp, synthetic construct
  misc_feature 1..32: note = synthetic oligonucleotide
  source 1..32: mol_type = other DNA
cgacagacgcctgatctgctggaaagtgaact

SEQ ID NO: 859 - DNA, 25 bp, synthetic construct
  misc_feature 1..25: note = synthetic oligonucleotide
  source 1..25: mol_type = other DNA
gatcagttcactttccagcagatca

SEQ ID NO: 860 - DNA, 32 bp, synthetic construct
  misc_feature 1..32: note = synthetic oligonucleotide
  source 1..32: mol_type = other DNA
cgacagacgcctgatctgctgaagacaacctt

SEQ ID NO: 861 - DNA, 25 bp, synthetic construct
  misc_feature 1..25: note = synthetic oligonucleotide
  source 1..25: mol_type = other DNA
gatcaaggttgtcttcagcagatca

SEQ ID NO: 862 - DNA, 32 bp, synthetic construct
  misc_feature 1..32: note = synthetic oligonucleotide
  source 1..32: mol_type = other DNA
cgacagacgcctgatctgctccataaagcctt

SEQ ID NO: 863 - DNA, 25 bp, synthetic construct
  misc_feature 1..25: note = synthetic oligonucleotide
  source 1..25: mol_type = other DNA
gatcaaggctttatggagcagatca

SEQ ID NO: 864 - DNA, 32 bp, synthetic construct
  misc_feature 1..32: note = synthetic oligonucleotide
  source 1..32: mol_type = other DNA
cgacagacgcctgatctgctcatttcctcgat

SEQ ID NO: 865 - DNA, 25 bp, synthetic construct
  misc_feature 1..25: note = synthetic oligonucleotide
  source 1..25: mol_type = other DNA
gatcatcgaggaaatgagcagatca

SEQ ID NO: 866 - DNA, 32 bp, synthetic construct
  misc_feature 1..32: note = synthetic oligonucleotide
  source 1..32: mol_type = other DNA
cgacagacgcctgatctgctcaccaacagatt

SEQ ID NO: 867 - DNA, 25 bp, synthetic construct
  misc_feature 1..25: note = synthetic oligonucleotide
  source 1..25: mol_type = other DNA
gatcaatctgttggtgagcagatca

SEQ ID NO: 868 - DNA, 32 bp, synthetic construct
  misc_feature 1..32: note = synthetic oligonucleotide
  source 1..32: mol_type = other DNA
cgacagacgcctgatctgctcacaaataccgt

SEQ ID NO: 869 - DNA, 25 bp, synthetic construct
  misc_feature 1..25: note = synthetic oligonucleotide
  source 1..25: mol_type = other DNA
gatcacggtatttgtgagcagatca

SEQ ID NO: 870 - DNA, 32 bp, synthetic construct
  misc_feature 1..32: note = synthetic oligonucleotide
  source 1..32: mol_type = other DNA
cgacagacgcctgatctgctatttggcgatct

SEQ ID NO: 871 - DNA, 25 bp, synthetic construct
  misc_feature 1..25: note = synthetic oligonucleotide
  source 1..25: mol_type = other DNA
gatcagatcgccaaatagcagatca

SEQ ID NO: 872 - DNA, 32 bp, synthetic construct
  misc_feature 1..32: note = synthetic oligonucleotide
  source 1..32: mol_type = other DNA
cgacagacgcctgatctgctatttacgccact

SEQ ID NO: 873 - DNA, 25 bp, synthetic construct
  misc_feature 1..25: note = synthetic oligonucleotide
  source 1..25: mol_type = other DNA
gatcagtggcgtaaatagcagatca

SEQ ID NO: 874 - DNA, 32 bp, synthetic construct
  misc_feature 1..32: note = synthetic oligonucleotide
  source 1..32: mol_type = other DNA
cgacagacgcctgatctgctattgctcctgat

SEQ ID NO: 875 - DNA, 25 bp, synthetic construct
  misc_feature 1..25: note = synthetic oligonucleotide
  source 1..25: mol_type = other DNA
gatcatcaggagcaatagcagatca

SEQ ID NO: 876 - DNA, 32 bp, synthetic construct
  misc_feature 1..32: note = synthetic oligonucleotide
  source 1..32: mol_type = other DNA
cgacagacgcctgatctgctaccaaaccagtt

SEQ ID NO: 877 - DNA, 25 bp, synthetic construct
  misc_feature 1..25: note = synthetic oligonucleotide
  source 1..25: mol_type = other DNA
gatcaactggtttggtagcagatca

SEQ ID NO: 878 - DNA, 32 bp, synthetic construct
  misc_feature 1..32: note = synthetic oligonucleotide
  source 1..32: mol_type = other DNA
cgacagacgcctgatctgctaaggcaaactgt

SEQ ID NO: 879 - DNA, 25 bp, synthetic construct
  misc_feature 1..25: note = synthetic oligonucleotide
  source 1..25: mol_type = other DNA
gatcacagtttgccttagcagatca

SEQ ID NO: 880 - DNA, 32 bp, synthetic construct
  misc_feature 1..32: note = synthetic oligonucleotide
  source 1..32: mol_type = other DNA
cgacagacgcctgatctgctaaagagtggcat

SEQ ID NO: 881 - DNA, 25 bp, synthetic construct
  misc_feature 1..25: note = synthetic oligonucleotide
  source 1..25: mol_type = other DNA
gatcatgccactctttagcagatca

SEQ ID NO: 882 - DNA, 32 bp, synthetic construct
  misc_feature 1..32: note = synthetic oligonucleotide
  source 1..32: mol_type = other DNA
cgacagacgcctgatctgcgtttactcctcat

SEQ ID NO: 883 - DNA, 25 bp, synthetic construct
  misc_feature 1..25: note = synthetic oligonucleotide
  source 1..25: mol_type = other DNA
gatcatgaggagtaaacgcagatca

SEQ ID NO: 884 - DNA, 32 bp, synthetic construct
  misc_feature 1..32: note = synthetic oligonucleotide
  source 1..32: mol_type = other DNA
cgacagacgcctgatctgcgttaatcctcctt

SEQ ID NO: 885 - DNA, 25 bp, synthetic construct
  misc_feature 1..25: note = synthetic oligonucleotide
  source 1..25: mol_type = other DNA
gatcaaggaggattaacgcagatca

SEQ ID NO: 886 - DNA, 32 bp, synthetic construct
  misc_feature 1..32: note = synthetic oligonucleotide
  source 1..32: mol_type = other DNA
cgacagacgcctgatctgcgaatctcttgtgt

SEQ ID NO: 887 - DNA, 25 bp, synthetic construct
  misc_feature 1..25: note = synthetic oligonucleotide
  source 1..25: mol_type = other DNA
gatcacacaagagattcgcagatca

SEQ ID NO: 888 - DNA, 32 bp, synthetic construct
  misc_feature 1..32: note = synthetic oligonucleotide
  source 1..32: mol_type = other DNA
cgacagacgcctgatctgcgaaatacaggtgt

SEQ ID NO: 889 - DNA, 25 bp, synthetic construct
  misc_feature 1..25: note = synthetic oligonucleotide
  source 1..25: mol_type = other DNA
gatcacacctgtatttcgcagatca

SEQ ID NO: 890 - DNA, 32 bp, synthetic construct
  misc_feature 1..32: note = synthetic oligonucleotide
  source 1..32: mol_type = other DNA
cgacagacgcctgatctgcgaaacattgaggt

SEQ ID NO: 891 - DNA, 25 bp, synthetic construct
  misc_feature 1..25: note = synthetic oligonucleotide
  source 1..25: mol_type = other DNA
gatcacctcaatgtttcgcagatca

SEQ ID NO: 892 - DNA, 32 bp, synthetic construct
  misc_feature 1..32: note = synthetic oligonucleotide
  source 1..32: mol_type = other DNA
cgacagacgcctgatctgccttaaactccgat

SEQ ID NO: 893 - DNA, 25 bp, synthetic construct
  misc_feature 1..25: note = synthetic oligonucleotide
  source 1..25: mol_type = other DNA
gatcatcggagtttaaggcagatca

SEQ ID NO: 894 - DNA, 32 bp, synthetic construct
  misc_feature 1..32: note = synthetic oligonucleotide
  source 1..32: mol_type = other DNA
cgacagacgcctgatctgcctggaaattgtgt

SEQ ID NO: 895 - DNA, 25 bp, synthetic construct
  misc_feature 1..25: note = synthetic oligonucleotide
  source 1..25: mol_type = other DNA
gatcacacaatttccaggcagatca

SEQ ID NO: 896 - DNA, 32 bp, synthetic construct
  misc_feature 1..32: note = synthetic oligonucleotide
  source 1..32: mol_type = other DNA
cgacagacgcctgatctgcctccttaatcgtt

SEQ ID NO: 897 - DNA, 25 bp, synthetic construct
  misc_feature 1..25: note = synthetic oligonucleotide
  source 1..25: mol_type = other DNA
gatcaacgattaaggaggcagatca

SEQ ID NO: 898 - DNA, 32 bp, synthetic construct
  misc_feature 1..32: note = synthetic oligonucleotide
  source 1..32: mol_type = other DNA
cgacagacgcctgatctgccggataaaggttt

SEQ ID NO: 899 - DNA, 25 bp, synthetic construct
  misc_feature 1..25: note = synthetic oligonucleotide
  source 1..25: mol_type = other DNA
gatcaaacctttatccggcagatca

SEQ ID NO: 900 - DNA, 32 bp, synthetic construct
  misc_feature 1..32: note = synthetic oligonucleotide
  source 1..32: mol_type = other DNA
cgacagacgcctgatctgccgcaaataatcct

SEQ ID NO: 901 - DNA, 25 bp, synthetic construct
  misc_feature 1..25: note = synthetic oligonucleotide
  source 1..25: mol_type = other DNA
gatcaggattatttgcggcagatca

SEQ ID NO: 902 - DNA, 32 bp, synthetic construct
  misc_feature 1..32: note = synthetic oligonucleotide
  source 1..32: mol_type = other DNA
cgacagacgcctgatctgccattgaaacacct

SEQ ID NO: 903 - DNA, 25 bp, synthetic construct
  misc_feature 1..25: note = synthetic oligonucleotide
  source 1..25: mol_type = other DNA
gatcaggtgtttcaatggcagatca

SEQ ID NO: 904 - DNA, 32 bp, synthetic construct
  misc_feature 1..32: note = synthetic oligonucleotide
  source 1..32: mol_type = other DNA
cgacagacgcctgatctgccataatgacacgt

SEQ ID NO: 905 - DNA, 25 bp, synthetic construct
  misc_feature 1..25: note = synthetic oligonucleotide
  source 1..25: mol_type = other DNA
gatcacgtgtcattatggcagatca

SEQ ID NO: 906 - DNA, 32 bp, synthetic construct
  misc_feature 1..32: note = synthetic oligonucleotide
  source 1..32: mol_type = other DNA
cgacagacgcctgatctgccaattgacctctt

SEQ ID NO: 907 - DNA, 25 bp, synthetic construct
  misc_feature 1..25: note = synthetic oligonucleotide
  source 1..25: mol_type = other DNA
gatcaagaggtcaattggcagatca

SEQ ID NO: 908 - DNA, 32 bp, synthetic construct
  misc_feature 1..32: note = synthetic oligonucleotide
  source 1..32: mol_type = other DNA
cgacagacgcctgatctgccaatatcctcgtt

SEQ ID NO: 909 - DNA, 25 bp, synthetic construct
  misc_feature 1..25: note = synthetic oligonucleotide
  source 1..25: mol_type = other DNA
gatcaacgaggatattggcagatca

SEQ ID NO: 910 - DNA, 32 bp, synthetic construct
  misc_feature 1..32: note = synthetic oligonucleotide
  source 1..32: mol_type = other DNA
cgacagacgcctgatctgcattccaactacgt

SEQ ID NO: 911 - DNA, 25 bp, synthetic construct
  misc_feature 1..25: note = synthetic oligonucleotide
  source 1..25: mol_type = other DNA
gatcacgtagttggaatgcagatca

SEQ ID NO: 912 - DNA, 32 bp, synthetic construct
  misc_feature 1..32: note = synthetic oligonucleotide
  source 1..32: mol_type = other DNA
cgacagacgcctgatctgcattaccagacgat

SEQ ID NO: 913 - DNA, 25 bp, synthetic construct
  misc_feature 1..25: note = synthetic oligonucleotide
  source 1..25: mol_type = other DNA
gatcatcgtctggtaatgcagatca

SEQ ID NO: 914 - DNA, 32 bp, synthetic construct
  misc_feature 1..32: note = synthetic oligonucleotide
  source 1..32: mol_type = other DNA
cgacagacgcctgatctgcatgatttggctct

SEQ ID NO: 915 - DNA, 25 bp, synthetic construct
  misc_feature 1..25: note = synthetic oligonucleotide
  source 1..25: mol_type = other DNA
gatcagagccaaatcatgcagatca

SEQ ID NO: 916 - DNA, 32 bp, synthetic construct
  misc_feature 1..32: note = synthetic oligonucleotide
  source 1..32: mol_type = other DNA
cgacagacgcctgatctgcatatacgccactt

SEQ ID NO: 917 - DNA, 25 bp, synthetic construct
  misc_feature 1..25: note = synthetic oligonucleotide
  source 1..25: mol_type = other DNA
gatcaagtggcgtatatgcagatca

SEQ ID NO: 918 - DNA, 32 bp, synthetic construct
  misc_feature 1..32: note = synthetic oligonucleotide
  source 1..32: mol_type = other DNA
cgacagacgcctgatctgcatataccaccgtt

SEQ ID NO: 919 - DNA, 25 bp, synthetic construct
  misc_feature 1..25: note = synthetic oligonucleotide
  source 1..25: mol_type = other DNA
gatcaacggtggtatatgcagatca

SEQ ID NO: 920 - DNA, 32 bp, synthetic construct
  misc_feature 1..32: note = synthetic oligonucleotide
  source 1..32: mol_type = other DNA
cgacagacgcctgatctgcatacaaggctcat

SEQ ID NO: 921 - DNA, 25 bp, synthetic construct
  misc_feature 1..25: note = synthetic oligonucleotide
  source 1..25: mol_type = other DNA
gatcatgagccttgtatgcagatca

SEQ ID NO: 922 - DNA, 32 bp, synthetic construct
  misc_feature 1..32: note = synthetic oligonucleotide
  source 1..32: mol_type = other DNA
cgacagacgcctgatctgcataaagatgccgt

SEQ ID NO: 923 - DNA, 25 bp, synthetic construct
  misc_feature 1..25: note = synthetic oligonucleotide
  source 1..25: mol_type = other DNA
gatcacggcatctttatgcagatca

SEQ ID NO: 924 - DNA, 32 bp, synthetic construct
  misc_feature 1..32: note = synthetic oligonucleotide
  source 1..32: mol_type = other DNA
cgacagacgcctgatctgcacatatcaaccgt

SEQ ID NO: 925 - DNA, 25 bp, synthetic construct
  misc_feature 1..25: note = synthetic oligonucleotide
  source 1..25: mol_type = other DNA
gatcacggttgatatgtgcagatca

SEQ ID NO: 926 - DNA, 32 bp, synthetic construct
  misc_feature 1..32: note = synthetic oligonucleotide
  source 1..32: mol_type = other DNA
cgacagacgcctgatctgcacactttatccgt

SEQ ID NO: 927 - DNA, 25 bp, synthetic construct
  misc_feature 1..25: note = synthetic oligonucleotide
  source 1..25: mol_type = other DNA
gatcacggataaagtgtgcagatca

SEQ ID NO: 928 - DNA, 32 bp, synthetic construct
  misc_feature 1..32: note = synthetic oligonucleotide
  source 1..32: mol_type = other DNA
cgacagacgcctgatctgcaatttggtcgagt

SEQ ID NO: 929 - DNA, 25 bp, synthetic construct
  misc_feature 1..25: note = synthetic oligonucleotide
  source 1..25: mol_type = other DNA
gatcactcgaccaaattgcagatca

SEQ ID NO: 930 - DNA, 32 bp, synthetic construct
  misc_feature 1..32: note = synthetic oligonucleotide
  source 1..32: mol_type = other DNA
cgacagacgcctgatctgcaatacacgtcact

SEQ ID NO: 931 - DNA, 25 bp, synthetic construct
  misc_feature 1..25: note = synthetic oligonucleotide
  source 1..25: mol_type = other DNA
gatcagtgacgtgtattgcagatca

SEQ ID NO: 932 - DNA, 32 bp, synthetic construct
  misc_feature 1..32: note = synthetic oligonucleotide
  source 1..32: mol_type = other DNA
cgacagacgcctgatctgcaagttagtcggat

SEQ ID NO: 933 - DNA, 25 bp, synthetic construct
  misc_feature 1..25: note = synthetic oligonucleotide
  source 1..25: mol_type = other DNA
gatcatccgactaacttgcagatca

SEQ ID NO: 934 - DNA, 32 bp, synthetic construct
  misc_feature 1..32: note = synthetic oligonucleotide
  source 1..32: mol_type = other DNA
cgacagacgcctgatctgcaactcctcatgtt

SEQ ID NO: 935 - DNA, 25 bp, synthetic construct
  misc_feature 1..25: note = synthetic oligonucleotide
  source 1..25: mol_type = other DNA
gatcaacatgaggagttgcagatca

SEQ ID NO: 936 - DNA, 32 bp, synthetic construct
  misc_feature 1..32: note = synthetic oligonucleotide
  source 1..32: mol_type = other DNA
cgacagacgcctgatctgcaacattcagacct

SEQ ID NO: 937 - DNA, 25 bp, synthetic construct
  misc_feature 1..25: note = synthetic oligonucleotide
  source 1..25: mol_type = other DNA
gatcaggtctgaatgttgcagatca

SEQ ID NO: 938 - DNA, 32 bp, synthetic construct
  misc_feature 1..32: note = synthetic oligonucleotide
  source 1..32: mol_type = other DNA
cgacagacgcctgatctgcaaatgatccacct

SEQ ID NO: 939 - DNA, 25 bp, synthetic construct
  misc_feature 1..25: note = synthetic oligonucleotide
  source 1..25: mol_type = other DNA
gatcaggtggatcatttgcagatca

SEQ ID NO: 940 - DNA, 32 bp, synthetic construct
  misc_feature 1..32: note = synthetic oligonucleotide
  source 1..32: mol_type = other DNA
cgacagacgcctgatctgcaaagcctcactat

SEQ ID NO: 941 - DNA, 25 bp, synthetic construct
  misc_feature 1..25: note = synthetic oligonucleotide
  source 1..25: mol_type = other DNA
gatcatagtgaggctttgcagatca

SEQ ID NO: 942 - DNA, 32 bp, synthetic construct
  misc_feature 1..32: note = synthetic oligonucleotide
  source 1..32: mol_type = other DNA
cgacagacgcctgatctgcaaactctcaacgt

SEQ ID NO: 943 - DNA, 25 bp, synthetic construct
  misc_feature 1..25: note = synthetic oligonucleotide
  source 1..25: mol_type = other DNA
gatcacgttgagagtttgcagatca

SEQ ID NO: 944 - DNA, 32 bp, synthetic construct
  misc_feature 1..32: note = synthetic oligonucleotide
  source 1..32: mol_type = other DNA
cgacagacgcctgatctgcaaacctgtcctat

SEQ ID NO: 945 - DNA, 25 bp, synthetic construct
  misc_feature 1..25: note = synthetic oligonucleotide
  source 1..25: mol_type = other DNA
gatcataggacaggtttgcagatca

SEQ ID NO: 946 - DNA, 32 bp, synthetic construct
  misc_feature 1..32: note = synthetic oligonucleotide
  source 1..32: mol_type = other DNA
cgacagacgcctgatctgattggtgcttacgt

SEQ ID NO: 947 - DNA, 25 bp, synthetic construct
  misc_feature 1..25: note = synthetic oligonucleotide
  source 1..25: mol_type = other DNA
gatcacgtaagcaccaatcagatca

SEQ ID NO: 948 - DNA, 32 bp, synthetic construct
  misc_feature 1..32: note = synthetic oligonucleotide
  source 1..32: mol_type = other DNA
cgacagacgcctgatctgattctgattggcgt

SEQ ID NO: 949 - DNA, 25 bp, synthetic construct
  misc_feature 1..25: note = synthetic oligonucleotide
  source 1..25: mol_type = other DNA
gatcacgccaatcagaatcagatca

SEQ ID NO: 950 - DNA, 32 bp, synthetic construct
  misc_feature 1..32: note = synthetic oligonucleotide
  source 1..32: mol_type = other DNA
cgacagacgcctgatctgattcgcatctcctt

SEQ ID NO: 951 - DNA, 25 bp, synthetic construct
  misc_feature 1..25: note = synthetic oligonucleotide
  source 1..25: mol_type = other DNA
gatcaaggagatgcgaatcagatca

SEQ ID NO: 952 - DNA, 32 bp, synthetic construct
  misc_feature 1..32: note = synthetic oligonucleotide
  source 1..32: mol_type = other DNA
cgacagacgcctgatctgattatcgttgccgt

SEQ ID NO: 953 - DNA, 25 bp, synthetic construct
  misc_feature 1..25: note = synthetic oligonucleotide
  source 1..25: mol_type = other DNA
gatcacggcaacgataatcagatca

SEQ ID NO: 954 - DNA, 32 bp, synthetic construct
  misc_feature 1..32: note = synthetic oligonucleotide
  source 1..32: mol_type = other DNA
cgacagacgcctgatctgatgctaaaccgtgt

SEQ ID NO: 955 - DNA, 25 bp, synthetic construct
  misc_feature 1..25: note = synthetic oligonucleotide
  source 1..25: mol_type = other DNA
gatcacacggtttagcatcagatca

SEQ ID NO: 956 - DNA, 32 bp, synthetic construct
  misc_feature 1..32: note = synthetic oligonucleotide
  source 1..32: mol_type = other DNA
cgacagacgcctgatctgatctccatcgcttt

SEQ ID NO: 957 - DNA, 25 bp, synthetic construct
  misc_feature 1..25: note = synthetic oligonucleotide
  source 1..25: mol_type = other DNA
gatcaaagcgatggagatcagatca

SEQ ID NO: 958 - DNA, 32 bp, synthetic construct
  misc_feature 1..32: note = synthetic oligonucleotide
  source 1..32: mol_type = other DNA
cgacagacgcctgatctgatctacgccacaat

SEQ ID NO: 959 - DNA, 25 bp, synthetic construct
  misc_feature 1..25: note = synthetic oligonucleotide
  source 1..25: mol_type = other DNA
gatcattgtggcgtagatcagatca

SEQ ID NO: 960 - DNA, 32 bp, synthetic construct
  misc_feature 1..32: note = synthetic oligonucleotide
  source 1..32: mol_type = other DNA
cgacagacgcctgatctgatccttgcaccttt

SEQ ID NO: 961 - DNA, 25 bp, synthetic construct
  misc_feature 1..25: note = synthetic oligonucleotide
  source 1..25: mol_type = other DNA
gatcaaaggtgcaaggatcagatca

SEQ ID NO: 962 - DNA, 32 bp, synthetic construct
  misc_feature 1..32: note = synthetic oligonucleotide
  source 1..32: mol_type = other DNA
cgacagacgcctgatctgatatttgctcgcct

SEQ ID NO: 963 - DNA, 25 bp, synthetic construct
  misc_feature 1..25: note = synthetic oligonucleotide
  source 1..25: mol_type = other DNA
gatcaggcgagcaaatatcagatca

SEQ ID NO: 964 - DNA, 32 bp, synthetic construct
  misc_feature 1..32: note = synthetic oligonucleotide
  source 1..32: mol_type = other DNA
cgacagacgcctgatctgatatttgcgcctgt

SEQ ID NO: 965 - DNA, 25 bp, synthetic construct
  misc_feature 1..25: note = synthetic oligonucleotide
  source 1..25: mol_type = other DNA
gatcacaggcgcaaatatcagatca

SEQ ID NO: 966 - DNA, 32 bp, synthetic construct
  misc_feature 1..32: note = synthetic oligonucleotide
  source 1..32: mol_type = other DNA
cgacagacgcctgatctgatagtgctttgcgt

SEQ ID NO: 967 - DNA, 25 bp, synthetic construct
  misc_feature 1..25: note = synthetic oligonucleotide
  source 1..25: mol_type = other DNA
gatcacgcaaagcactatcagatca

SEQ ID NO: 968 - DNA, 32 bp, synthetic construct
  misc_feature 1..32: note = synthetic oligonucleotide
  source 1..32: mol_type = other DNA
cgacagacgcctgatctgataatgccgtgtgt

SEQ ID NO: 969 - DNA, 25 bp, synthetic construct
  misc_feature 1..25: note = synthetic oligonucleotide
  source 1..25: mol_type = other DNA
gatcacacacggcattatcagatca

SEQ ID NO: 970 - DNA, 32 bp, synthetic construct
  misc_feature 1..32: note = synthetic oligonucleotide
  source 1..32: mol_type = other DNA
cgacagacgcctgatctgataatcaccgccat

SEQ ID NO: 971 - DNA, 25 bp, synthetic construct
  misc_feature 1..25: note = synthetic oligonucleotide
  source 1..25: mol_type = other DNA
gatcatggcggtgattatcagatca

SEQ ID NO: 972 - DNA, 32 bp, synthetic construct
  misc_feature 1..32: note = synthetic oligonucleotide
  source 1..32: mol_type = other DNA
cgacagacgcctgatctgataagtcgtggcat

SEQ ID NO: 973 - DNA, 25 bp, synthetic construct
  misc_feature 1..25: note = synthetic oligonucleotide
  source 1..25: mol_type = other DNA
gatcatgccacgacttatcagatca

SEQ ID NO: 974 - DNA, 32 bp, synthetic construct
  misc_feature 1..32: note = synthetic oligonucleotide
  source 1..32: mol_type = other DNA
cgacagacgcctgatctgataactgtggcgat

SEQ ID NO: 975 - DNA, 25 bp, synthetic construct
  misc_feature 1..25: note = synthetic oligonucleotide
  source 1..25: mol_type = other DNA
gatcatcgccacagttatcagatca

SEQ ID NO: 976 - DNA, 32 bp, synthetic construct
  misc_feature 1..32: note = synthetic oligonucleotide
  source 1..32: mol_type = other DNA
cgacagacgcctgatctgagttgaaatgccgt

SEQ ID NO: 977 - DNA, 25 bp, synthetic construct
  misc_feature 1..25: note = synthetic oligonucleotide
  source 1..25: mol_type = other DNA
gatcacggcatttcaactcagatca

SEQ ID NO: 978 - DNA, 32 bp, synthetic construct
  misc_feature 1..32: note = synthetic oligonucleotide
  source 1..32: mol_type = other DNA
cgacagacgcctgatctgagtcaaactccgtt

SEQ ID NO: 979 - DNA, 25 bp, synthetic construct
  misc_feature 1..25: note = synthetic oligonucleotide
  source 1..25: mol_type = other DNA
gatcaacggagtttgactcagatca

SEQ ID NO: 980 - DNA, 32 bp, synthetic construct
  misc_feature 1..32: note = synthetic oligonucleotide
  source 1..32: mol_type = other DNA
cgacagacgcctgatctgagtaatccgcacat

SEQ ID NO: 981 - DNA, 25 bp, synthetic construct
  misc_feature 1..25: note = synthetic oligonucleotide
  source 1..25: mol_type = other DNA
gatcatgtgcggattactcagatca

SEQ ID NO: 982 - DNA, 32 bp, synthetic construct
  misc_feature 1..32: note = synthetic oligonucleotide
  source 1..32: mol_type = other DNA
cgacagacgcctgatctgaggtttgttcacgt

SEQ ID NO: 983 - DNA, 25 bp, synthetic construct
  misc_feature 1..25: note = synthetic oligonucleotide
  source 1..25: mol_type = other DNA
gatcacgtgaacaaacctcagatca

SEQ ID NO: 984 - DNA, 32 bp, synthetic construct
  misc_feature 1..32: note = synthetic oligonucleotide
  source 1..32: mol_type = other DNA
cgacagacgcctgatctgaggccattgtttgt

SEQ ID NO: 985 - DNA, 25 bp, synthetic construct
  misc_feature 1..25: note = synthetic oligonucleotide
  source 1..25: mol_type = other DNA
gatcacaaacaatggcctcagatca

SEQ ID NO: 986 - DNA, 32 bp, synthetic construct
  misc_feature 1..32: note = synthetic oligonucleotide
  source 1..32: mol_type = other DNA
cgacagacgcctgatctgaggataaacggctt

SEQ ID NO: 987 - DNA, 25 bp, synthetic construct
  misc_feature 1..25: note = synthetic oligonucleotide
  source 1..25: mol_type = other DNA
gatcaagccgtttatcctcagatca

SEQ ID NO: 988 - DNA, 32 bp, synthetic construct
  misc_feature 1..32: note = synthetic oligonucleotide
  source 1..32: mol_type = other DNA
cgacagacgcctgatctgagcgaaatcatggt

SEQ ID NO: 989 - DNA, 25 bp, synthetic construct
  misc_feature 1..25: note = synthetic oligonucleotide
  source 1..25: mol_type = other DNA
gatcaccatgatttcgctcagatca

SEQ ID NO: 990 - DNA, 32 bp, synthetic construct
  misc_feature 1..32: note = synthetic oligonucleotide
  source 1..32: mol_type = other DNA
cgacagacgcctgatctgagcctccacaattt

SEQ ID NO: 991 - DNA, 25 bp, synthetic construct
  misc_feature 1..25: note = synthetic oligonucleotide
  source 1..25: mol_type = other DNA
gatcaaattgtggaggctcagatca

SEQ ID NO: 992 - DNA, 32 bp, synthetic construct
  misc_feature 1..32: note = synthetic oligonucleotide
  source 1..32: mol_type = other DNA
cgacagacgcctgatctgagatacaaccgctt

SEQ ID NO: 993 - DNA, 25 bp, synthetic construct
  misc_feature 1..25: note = synthetic oligonucleotide
  source 1..25: mol_type = other DNA
gatcaagcggttgtatctcagatca

SEQ ID NO: 994 - DNA, 32 bp, synthetic construct
  misc_feature 1..32: note = synthetic oligonucleotide
  source 1..32: mol_type = other DNA
cgacagacgcctgatctgagataacgctcgat

SEQ ID NO: 995 - DNA, 25 bp, synthetic construct
  misc_feature 1..25: note = synthetic oligonucleotide
  source 1..25: mol_type = other DNA
gatcatcgagcgttatctcagatca

SEQ ID NO: 996 - DNA, 32 bp, synthetic construct
  misc_feature 1..32: note = synthetic oligonucleotide
  source 1..32: mol_type = other DNA
cgacagacgcctgatctgagacttatgcggtt

SEQ ID NO: 997 - DNA, 25 bp, synthetic construct
  misc_feature 1..25: note = synthetic oligonucleotide
  source 1..25: mol_type = other DNA
gatcaaccgcataagtctcagatca

SEQ ID NO: 998 - DNA, 32 bp, synthetic construct
  misc_feature 1..32: note = synthetic oligonucleotide
  source 1..32: mol_type = other DNA
cgacagacgcctgatctgagaccacacacttt

SEQ ID NO: 999 - DNA, 25 bp, synthetic construct
  misc_feature 1..25: note = synthetic oligonucleotide
  source 1..25: mol_type = other DNA
gatcaaagtgtgtggtctcagatca

SEQ ID NO: 1000 - DNA, 32 bp, synthetic construct
  misc_feature 1..32: note = synthetic oligonucleotide
  source 1..32: mol_type = other DNA
cgacagacgcctgatctgagaatgctacggtt

SEQ ID NO: 1001 - DNA, 25 bp, synthetic construct
  misc_feature 1..25: note = synthetic oligonucleotide
  source 1..25: mol_type = other DNA
gatcaaccgtagcattctcagatca

SEQ ID NO: 1002 - DNA, 32 bp, synthetic construct
  misc_feature 1..32: note = synthetic oligonucleotide
  source 1..32: mol_type = other DNA
cgacagacgcctgatctgagaaccttgagcat

SEQ ID NO: 1003 - DNA, 25 bp, synthetic construct
  misc_feature 1..25: note = synthetic oligonucleotide
  source 1..25: mol_type = other DNA
gatcatgctcaaggttctcagatca

SEQ ID NO: 1004 - DNA, 32 bp, synthetic construct
  misc_feature 1..32: note = synthetic oligonucleotide
  source 1..32: mol_type = other DNA
cgacagacgcctgatctgactttgacggttgt

SEQ ID NO: 1005 - DNA, 25 bp, synthetic construct
  misc_feature 1..25: note = synthetic oligonucleotide
  source 1..25: mol_type = other DNA
gatcacaaccgtcaaagtcagatca

SEQ ID NO: 1006 - DNA, 32 bp, synthetic construct
  misc_feature 1..32: note = synthetic oligonucleotide
  source 1..32: mol_type = other DNA
cgacagacgcctgatctgacttggatggcttt

SEQ ID NO: 1007 - DNA, 25 bp, synthetic construct
  misc_feature 1..25: note = synthetic oligonucleotide
  source 1..25: mol_type = other DNA
gatcaaagccatccaagtcagatca

SEQ ID NO: 1008 - DNA, 32 bp, synthetic construct
  misc_feature 1..32: note = synthetic oligonucleotide
  source 1..32: mol_type = other DNA
cgacagacgcctgatctgacttccaaaccgat

SEQ ID NO: 1009 - DNA, 25 bp, synthetic construct
  misc_feature 1..25: note = synthetic oligonucleotide
  source 1..25: mol_type = other DNA
gatcatcggtttggaagtcagatca

SEQ ID NO: 1010 - DNA, 32 bp, synthetic construct
  misc_feature 1..32: note = synthetic oligonucleotide
  source 1..32: mol_type = other DNA
cgacagacgcctgatctgactaactgcaccat

SEQ ID NO: 1011 - DNA, 25 bp, synthetic construct
  misc_feature 1..25: note = synthetic oligonucleotide
  source 1..25: mol_type = other DNA
gatcatggtgcagttagtcagatca

SEQ ID NO: 1012 - DNA, 32 bp, synthetic construct
  misc_feature 1..32: note = synthetic oligonucleotide
  source 1..32: mol_type = other DNA
cgacagacgcctgatctgacgtttcctccatt

SEQ ID NO: 1013 - DNA, 25 bp, synthetic construct
  misc_feature 1..25: note = synthetic oligonucleotide
  source 1..25: mol_type = other DNA
gatcaatggaggaaacgtcagatca

SEQ ID NO: 1014 - DNA, 32 bp, synthetic construct
  misc_feature 1..32: note = synthetic oligonucleotide
  source 1..32: mol_type = other DNA
cgacagacgcctgatctgaccattcttccgat

SEQ ID NO: 1015 - DNA, 25 bp, synthetic construct
  misc_feature 1..25: note = synthetic oligonucleotide
  source 1..25: mol_type = other DNA
gatcatcggaagaatggtcagatca

SEQ ID NO: 1016 - DNA, 32 bp, synthetic construct
  misc_feature 1..32: note = synthetic oligonucleotide
  source 1..32: mol_type = other DNA
cgacagacgcctgatctgaccaactaaccgtt

SEQ ID NO: 1017 - DNA, 25 bp, synthetic construct
  misc_feature 1..25: note = synthetic oligonucleotide
  source 1..25: mol_type = other DNA
gatcaacggttagttggtcagatca

SEQ ID NO: 1018 - DNA, 32 bp, synthetic construct
  misc_feature 1..32: note = synthetic oligonucleotide
  source 1..32: mol_type = other DNA
cgacagacgcctgatctgacatgctttacggt

SEQ ID NO: 1019 - DNA, 25 bp, synthetic construct
  misc_feature 1..25: note = synthetic oligonucleotide
  source 1..25: mol_type = other DNA
gatcaccgtaaagcatgtcagatca

SEQ ID NO: 1020 - DNA, 32 bp, synthetic construct
  misc_feature 1..32: note = synthetic oligonucleotide
  source 1..32: mol_type = other DNA
cgacagacgcctgatctgacaatggagacgtt

SEQ ID NO: 1021 - DNA, 25 bp, synthetic construct
  misc_feature 1..25: note = synthetic oligonucleotide
  source 1..25: mol_type = other DNA
gatcaacgtctccattgtcagatca

SEQ ID NO: 1022 - DNA, 32 bp, synthetic construct
  misc_feature 1..32: note = synthetic oligonucleotide
  source 1..32: mol_type = other DNA
cgacagacgcctgatctgaatttgtccagcgt

SEQ ID NO: 1023 - DNA, 25 bp, synthetic construct
  misc_feature 1..25: note = synthetic oligonucleotide
  source 1..25: mol_type = other DNA
gatcacgctggacaaattcagatca

SEQ ID NO: 1024 - DNA, 32 bp, synthetic construct
  misc_feature 1..32: note = synthetic oligonucleotide
  source 1..32: mol_type = other DNA
cgacagacgcctgatctgaatttgagcggact

SEQ ID NO: 1025 - DNA, 25 bp, synthetic construct
  misc_feature 1..25: note = synthetic oligonucleotide
  source 1..25: mol_type = other DNA
gatcagtccgctcaaattcagatca

SEQ ID NO: 1026 - DNA, 32 bp, synthetic construct
  misc_feature 1..32: note = synthetic oligonucleotide
  source 1..32: mol_type = other DNA
cgacagacgcctgatctgaatttcagagcggt

SEQ ID NO: 1027 - DNA, 25 bp, synthetic construct
  misc_feature 1..25: note = synthetic oligonucleotide
  source 1..25: mol_type = other DNA
gatcaccgctctgaaattcagatca

SEQ ID NO: 1028 - DNA, 32 bp, synthetic construct
  misc_feature 1..32: note = synthetic oligonucleotide
  source 1..32: mol_type = other DNA
cgacagacgcctgatctgaatgtctctcgctt

SEQ ID NO: 1029 - DNA, 25 bp, synthetic construct
  misc_feature 1..25: note = synthetic oligonucleotide
  source 1..25: mol_type = other DNA
gatcaagcgagagacattcagatca

SEQ ID NO: 1030 - DNA, 32 bp, synthetic construct
  misc_feature 1..32: note = synthetic oligonucleotide
  source 1..32: mol_type = other DNA
cgacagacgcctgatctgaatggtcttggctt

SEQ ID NO: 1031 - DNA, 25 bp, synthetic construct
  misc_feature 1..25: note = synthetic oligonucleotide
  source 1..25: mol_type = other DNA
gatcaagccaagaccattcagatca

SEQ ID NO: 1032 - DNA, 32 bp, synthetic construct
  misc_feature 1..32: note = synthetic oligonucleotide
  source 1..32: mol_type = other DNA
cgacagacgcctgatctgaatgcctcttccat

SEQ ID NO: 1033 - DNA, 25 bp, synthetic construct
  misc_feature 1..25: note = synthetic oligonucleotide
  source 1..25: mol_type = other DNA
gatcatggaagaggcattcagatca

SEQ ID NO: 1034 - DNA, 32 bp, synthetic construct
  misc_feature 1..32: note = synthetic oligonucleotide
  source 1..32: mol_type = other DNA
cgacagacgcctgatctgaatgattgccgagt

SEQ ID NO: 1035 - DNA, 25 bp, synthetic construct
  misc_feature 1..25: note = synthetic oligonucleotide
  source 1..25: mol_type = other DNA
gatcactcggcaatcattcagatca

SEQ ID NO: 1036 - DNA, 32 bp, synthetic construct
  misc_feature 1..32: note = synthetic oligonucleotide
  source 1..32: mol_type = other DNA
cgacagacgcctgatctgaatgaactgagcgt

SEQ ID NO: 1037 - DNA, 25 bp, synthetic construct
  misc_feature 1..25: note = synthetic oligonucleotide
  source 1..25: mol_type = other DNA
gatcacgctcagttcattcagatca

SEQ ID NO: 1038 - DNA, 32 bp, synthetic construct
  misc_feature 1..32: note = synthetic oligonucleotide
  source 1..32: mol_type = other DNA
cgacagacgcctgatctgaatcgagaagcctt

SEQ ID NO: 1039 - DNA, 25 bp, synthetic construct
  misc_feature 1..25: note = synthetic oligonucleotide
  source 1..25: mol_type = other DNA
gatcaaggcttctcgattcagatca

SEQ ID NO: 1040 - DNA, 32 bp, synthetic construct
  misc_feature 1..32: note = synthetic oligonucleotide
  source 1..32: mol_type = other DNA
cgacagacgcctgatctgaatcctcaccgaat

SEQ ID NO: 1041 - DNA, 25 bp, synthetic construct
  misc_feature 1..25: note = synthetic oligonucleotide
  source 1..25: mol_type = other DNA
gatcattcggtgaggattcagatca

SEQ ID NO: 1042 - DNA, 32 bp, synthetic construct
  misc_feature 1..32: note = synthetic oligonucleotide
  source 1..32: mol_type = other DNA
cgacagacgcctgatctgaatcatttggcggt

SEQ ID NO: 1043 - DNA, 25 bp, synthetic construct
  misc_feature 1..25: note = synthetic oligonucleotide
  source 1..25: mol_type = other DNA
gatcaccgccaaatgattcagatca

SEQ ID NO: 1044 - DNA, 32 bp, synthetic construct
  misc_feature 1..32: note = synthetic oligonucleotide
  source 1..32: mol_type = other DNA
cgacagacgcctgatctgaatatgcctcggtt

SEQ ID NO: 1045 - DNA, 25 bp, synthetic construct
  misc_feature 1..25: note = synthetic oligonucleotide
  source 1..25: mol_type = other DNA
gatcaaccgaggcatattcagatca

SEQ ID NO: 1046 - DNA, 32 bp, synthetic construct
  misc_feature 1..32: note = synthetic oligonucleotide
  source 1..32: mol_type = other DNA
cgacagacgcctgatctgaagttgttgaccgt

SEQ ID NO: 1047 - DNA, 25 bp, synthetic construct
  misc_feature 1..25: note = synthetic oligonucleotide
  source 1..25: mol_type = other DNA
gatcacggtcaacaacttcagatca

SEQ ID NO: 1048 - DNA, 32 bp, synthetic construct
  misc_feature 1..32: note = synthetic oligonucleotide
  source 1..32: mol_type = other DNA
cgacagacgcctgatctgaagttcgcaagagt

SEQ ID NO: 1049 - DNA, 25 bp, synthetic construct
  misc_feature 1..25: note = synthetic oligonucleotide
  source 1..25: mol_type = other DNA
gatcactcttgcgaacttcagatca

SEQ ID NO: 1050 - DNA, 32 bp, synthetic construct
  misc_feature 1..32: note = synthetic oligonucleotide
  source 1..32: mol_type = other DNA
cgacagacgcctgatctgaagttatggcacgt

SEQ ID NO: 1051 - DNA, 25 bp, synthetic construct
  misc_feature 1..25: note = synthetic oligonucleotide
  source 1..25: mol_type = other DNA
gatcacgtgccataacttcagatca

SEQ ID NO: 1052 - DNA, 32 bp, synthetic construct
  misc_feature 1..32: note = synthetic oligonucleotide
  source 1..32: mol_type = other DNA
cgacagacgcctgatctgaaggcaattcgagt

SEQ ID NO: 1053 - DNA, 25 bp, synthetic construct
  misc_feature 1..25: note = synthetic oligonucleotide
  source 1..25: mol_type = other DNA
gatcactcgaattgccttcagatca

SEQ ID NO: 1054 - DNA, 32 bp, synthetic construct
  misc_feature 1..32: note = synthetic oligonucleotide
  source 1..32: mol_type = other DNA
cgacagacgcctgatctgaagactcgttggat

SEQ ID NO: 1055 - DNA, 25 bp, synthetic construct
  misc_feature 1..25: note = synthetic oligonucleotide
  source 1..25: mol_type = other DNA
gatcatccaacgagtcttcagatca

SEQ ID NO: 1056 - DNA, 32 bp, synthetic construct
  misc_feature 1..32: note = synthetic oligonucleotide
  source 1..32: mol_type = other DNA
cgacagacgcctgatctgaagacacttccgat

SEQ ID NO: 1057 - DNA, 25 bp, synthetic construct
  misc_feature 1..25: note = synthetic oligonucleotide
  source 1..25: mol_type = other DNA
gatcatcggaagtgtcttcagatca

SEQ ID NO: 1058 - DNA, 32 bp, synthetic construct
  misc_feature 1..32: note = synthetic oligonucleotide
  source 1..32: mol_type = other DNA
cgacagacgcctgatctgaactctttcacgct

SEQ ID NO: 1059 - DNA, 25 bp, synthetic construct
  misc_feature 1..25: note = synthetic oligonucleotide
  source 1..25: mol_type = other DNA
gatcagcgtgaaagagttcagatca

SEQ ID NO: 1060 - DNA, 32 bp, synthetic construct
  misc_feature 1..32: note = synthetic oligonucleotide
  source 1..32: mol_type = other DNA
cgacagacgcctgatctgaacgtactcaccat

SEQ ID NO: 1061 - DNA, 25 bp, synthetic construct
  misc_feature 1..25: note = synthetic oligonucleotide
  source 1..25: mol_type = other DNA
gatcatggtgagtacgttcagatca

SEQ ID NO: 1062 - DNA, 32 bp, synthetic construct
  misc_feature 1..32: note = synthetic oligonucleotide
  source 1..32: mol_type = other DNA
cgacagacgcctgatctgaaccttgcttcctt

SEQ ID NO: 1063 - DNA, 25 bp, synthetic construct
  misc_feature 1..25: note = synthetic oligonucleotide
  source 1..25: mol_type = other DNA
gatcaaggaagcaaggttcagatca

SEQ ID NO: 1064 - DNA, 32 bp, synthetic construct
  misc_feature 1..32: note = synthetic oligonucleotide
  source 1..32: mol_type = other DNA
cgacagacgcctgatctgaaattcgtgctggt

SEQ ID NO: 1065 - DNA, 25 bp, synthetic construct
  misc_feature 1..25: note = synthetic oligonucleotide
  source 1..25: mol_type = other DNA
gatcaccagcacgaatttcagatca

SEQ ID NO: 1066 - DNA, 32 bp, synthetic construct
  misc_feature 1..32: note = synthetic oligonucleotide
  source 1..32: mol_type = other DNA
cgacagacgcctgatctgaaattcctcgcctt

SEQ ID NO: 1067 - DNA, 25 bp, synthetic construct
  misc_feature 1..25: note = synthetic oligonucleotide
  source 1..25: mol_type = other DNA
gatcaaggcgaggaatttcagatca

SEQ ID NO: 1068 - DNA, 32 bp, synthetic construct
  misc_feature 1..32: note = synthetic oligonucleotide
  source 1..32: mol_type = other DNA
cgacagacgcctgatctgaaatgcttggacgt

SEQ ID NO: 1069 - DNA, 25 bp, synthetic construct
  misc_feature 1..25: note = synthetic oligonucleotide
  source 1..25: mol_type = other DNA
gatcacgtccaagcatttcagatca

SEQ ID NO: 1070 - DNA, 32 bp, synthetic construct
  misc_feature 1..32: note = synthetic oligonucleotide
  source 1..32: mol_type = other DNA
cgacagacgcctgatctgaaagtccaccgatt

SEQ ID NO: 1071 - DNA, 25 bp, synthetic construct
  misc_feature 1..25: note = synthetic oligonucleotide
  source 1..25: mol_type = other DNA
gatcaatcggtggactttcagatca

SEQ ID NO: 1072 - DNA, 32 bp, synthetic construct
  misc_feature 1..32: note = synthetic oligonucleotide
  source 1..32: mol_type = other DNA
cgacagacgcctgatctgaaactctgcaacct

SEQ ID NO: 1073 - DNA, 25 bp, synthetic construct
  misc_feature 1..25: note = synthetic oligonucleotide
  source 1..25: mol_type = other DNA
gatcaggttgcagagtttcagatca

SEQ ID NO: 1074 - DNA, 32 bp, synthetic construct
  misc_feature 1..32: note = synthetic oligonucleotide
  source 1..32: mol_type = other DNA
cgacagacgcctgatctgaaacggatggctat

SEQ ID NO: 1075 - DNA, 25 bp, synthetic construct
  misc_feature 1..25: note = synthetic oligonucleotide
  source 1..25: mol_type = other DNA
gatcatagccatccgtttcagatca

SEQ ID NO: 1076 - DNA, 32 bp, synthetic construct
  misc_feature 1..32: note = synthetic oligonucleotide
  source 1..32: mol_type = other DNA
cgacagacgcctgatctgaaaccattccacgt

SEQ ID NO: 1077 - DNA, 25 bp, synthetic construct
  misc_feature 1..25: note = synthetic oligonucleotide
  source 1..25: mol_type = other DNA
gatcacgtggaatggtttcagatca

SEQ ID NO: 1078 - DNA, 32 bp, synthetic construct
  misc_feature 1..32: note = synthetic oligonucleotide
  source 1..32: mol_type = other DNA
cgacagacgcctgatctctttgacggagtgtt

SEQ ID NO: 1079 - DNA, 25 bp, synthetic construct
  misc_feature 1..25: note = synthetic oligonucleotide
  source 1..25: mol_type = other DNA
gatcaacactccgtcaaagagatca

SEQ ID NO: 1080 - DNA, 32 bp, synthetic construct
  misc_feature 1..32: note = synthetic oligonucleotide
  source 1..32: mol_type = other DNA
cgacagacgcctgatctctttgaaggcaggat

SEQ ID NO: 1081 - DNA, 25 bp, synthetic construct
  misc_feature 1..25: note = synthetic oligonucleotide
  source 1..25: mol_type = other DNA
gatcatcctgccttcaaagagatca

SEQ ID NO: 1082 - DNA, 32 bp, synthetic construct
  misc_feature 1..32: note = synthetic oligonucleotide
  source 1..32: mol_type = other DNA
cgacagacgcctgatctctttcctaagccgtt

SEQ ID NO: 1083 - DNA, 25 bp, synthetic construct
  misc_feature 1..25: note = synthetic oligonucleotide
  source 1..25: mol_type = other DNA
gatcaacggcttaggaaagagatca

SEQ ID NO: 1084 - DNA, 32 bp, synthetic construct
  misc_feature 1..32: note = synthetic oligonucleotide
  source 1..32: mol_type = other DNA
cgacagacgcctgatctcttgtgaggcgtatt

SEQ ID NO: 1085 - DNA, 25 bp, synthetic construct
  misc_feature 1..25: note = synthetic oligonucleotide
  source 1..25: mol_type = other DNA
gatcaatacgcctcacaagagatca

SEQ ID NO: 1086 - DNA, 32 bp, synthetic construct
  misc_feature 1..32: note = synthetic oligonucleotide
  source 1..32: mol_type = other DNA
cgacagacgcctgatctcttgccaacagaact

SEQ ID NO: 1087 - DNA, 25 bp, synthetic construct
  misc_feature 1..25: note = synthetic oligonucleotide
  source 1..25: mol_type = other DNA
gatcagttctgttggcaagagatca

SEQ ID NO: 1088 - DNA, 32 bp, synthetic construct
  misc_feature 1..32: note = synthetic oligonucleotide
  source 1..32: mol_type = other DNA
cgacagacgcctgatctcttgatatggcggtt

SEQ ID NO: 1089 - DNA, 25 bp, synthetic construct
  misc_feature 1..25: note = synthetic oligonucleotide
  source 1..25: mol_type = other DNA
gatcaaccgccatatcaagagatca

SEQ ID NO: 1090 - DNA, 32 bp, synthetic construct
  misc_feature 1..32: note = synthetic oligonucleotide
  source 1..32: mol_type = other DNA
cgacagacgcctgatctcttgaggttagcgat

SEQ ID NO: 1091 - DNA, 25 bp, synthetic construct
  misc_feature 1..25: note = synthetic oligonucleotide
  source 1..25: mol_type = other DNA
gatcatcgctaacctcaagagatca

SEQ ID NO: 1092 - DNA, 32 bp, synthetic construct
  misc_feature 1..32: note = synthetic oligonucleotide
  source 1..32: mol_type = other DNA
cgacagacgcctgatctcttgaacacagcact

SEQ ID NO: 1093 - DNA, 25 bp, synthetic construct
  misc_feature 1..25: note = synthetic oligonucleotide
  source 1..25: mol_type = other DNA
gatcagtgctgtgttcaagagatca

SEQ ID NO: 1094 - DNA, 32 bp, synthetic construct
  misc_feature 1..32: note = synthetic oligonucleotide
  source 1..32: mol_type = other DNA
cgacagacgcctgatctcttcttgaatcgcct

SEQ ID NO: 1095 - DNA, 25 bp, synthetic construct
  misc_feature 1..25: note = synthetic oligonucleotide
  source 1..25: mol_type = other DNA
gatcaggcgattcaagaagagatca

SEQ ID NO: 1096 - DNA, 32 bp, synthetic construct
  misc_feature 1..32: note = synthetic oligonucleotide
  source 1..32: mol_type = other DNA
cgacagacgcctgatctcttcgcaatgaacct

SEQ ID NO: 1097 - DNA, 25 bp, synthetic construct
  misc_feature 1..25: note = synthetic oligonucleotide
  source 1..25: mol_type = other DNA
gatcaggttcattgcgaagagatca

SEQ ID NO: 1098 - DNA, 32 bp, synthetic construct
  misc_feature 1..32: note = synthetic oligonucleotide
  source 1..32: mol_type = other DNA
cgacagacgcctgatctcttccaagaatcgct

SEQ ID NO: 1099 - DNA, 25 bp, synthetic construct
  misc_feature 1..25: note = synthetic oligonucleotide
  source 1..25: mol_type = other DNA
gatcagcgattcttggaagagatca

SEQ ID NO: 1100 - DNA, 32 bp, synthetic construct
  misc_feature 1..32: note = synthetic oligonucleotide
  source 1..32: mol_type = other DNA
cgacagacgcctgatctcttcaacaagacgct

SEQ ID NO: 1101 - DNA, 25 bp, synthetic construct
  misc_feature 1..25: note = synthetic oligonucleotide
  source 1..25: mol_type = other DNA
gatcagcgtcttgttgaagagatca

SEQ ID NO: 1102 - DNA, 32 bp, synthetic construct
  misc_feature 1..32: note = synthetic oligonucleotide
  source 1..32: mol_type = other DNA
cgacagacgcctgatctcttagaggcgaacat

SEQ ID NO: 1103 - DNA, 25 bp, synthetic construct
  misc_feature 1..25: note = synthetic oligonucleotide
  source 1..25: mol_type = other DNA
gatcatgttcgcctctaagagatca

SEQ ID NO: 1104 - DNA, 32 bp, synthetic construct
  misc_feature 1..32: note = synthetic oligonucleotide
  source 1..32: mol_type = other DNA
cgacagacgcctgatctcttacatgaggcgtt

SEQ ID NO: 1105 - DNA, 25 bp, synthetic construct
  misc_feature 1..25: note = synthetic oligonucleotide
  source 1..25: mol_type = other DNA
gatcaacgcctcatgtaagagatca

SEQ ID NO: 1106 - DNA, 32 bp, synthetic construct
  misc_feature 1..32: note = synthetic oligonucleotide
  source 1..32: mol_type = other DNA
cgacagacgcctgatctcttacagcaaaggct

SEQ ID NO: 1107 - DNA, 25 bp, synthetic construct
  misc_feature 1..25: note = synthetic oligonucleotide
  source 1..25: mol_type = other DNA
gatcagcctttgctgtaagagatca

SEQ ID NO: 1108 - DNA, 32 bp, synthetic construct
  misc_feature 1..32: note = synthetic oligonucleotide
  source 1..32: mol_type = other DNA
cgacagacgcctgatctcttaaggtggctgtt

SEQ ID NO: 1109 - DNA, 25 bp, synthetic construct
  misc_feature 1..25: note = synthetic oligonucleotide
  source 1..25: mol_type = other DNA
gatcaacagccaccttaagagatca

SEQ ID NO: 1110 - DNA, 32 bp, synthetic construct
  misc_feature 1..32: note = synthetic oligonucleotide
  source 1..32: mol_type = other DNA
cgacagacgcctgatctcttaaagcggatgct

SEQ ID NO: 1111 - DNA, 25 bp, synthetic construct
  misc_feature 1..25: note = synthetic oligonucleotide
  source 1..25: mol_type = other DNA
gatcagcatccgctttaagagatca

SEQ ID NO: 1112 - DNA, 32 bp, synthetic construct
  misc_feature 1..32: note = synthetic oligonucleotide
  source 1..32: mol_type = other DNA
cgacagacgcctgatctctgtttaagtggcgt

SEQ ID NO: 1113 - DNA, 25 bp, synthetic construct
  misc_feature 1..25: note = synthetic oligonucleotide
  source 1..25: mol_type = other DNA
gatcacgccacttaaacagagatca

SEQ ID NO: 1114 - DNA, 32 bp, synthetic construct
  misc_feature 1..32: note = synthetic oligonucleotide
  source 1..32: mol_type = other DNA
cgacagacgcctgatctctgttgtgaagtgct

SEQ ID NO: 1115 - DNA, 25 bp, synthetic construct
  misc_feature 1..25: note = synthetic oligonucleotide
  source 1..25: mol_type = other DNA
gatcagcacttcacaacagagatca

SEQ ID NO: 1116 - DNA, 32 bp, synthetic construct
  misc_feature 1..32: note = synthetic oligonucleotide
  source 1..32: mol_type = other DNA
cgacagacgcctgatctctgtaaacaacgcct

SEQ ID NO: 1117 - DNA, 25 bp, synthetic construct
  misc_feature 1..25: note = synthetic oligonucleotide
  source 1..25: mol_type = other DNA
gatcaggcgttgtttacagagatca

SEQ ID NO: 1118 - DNA, 32 bp, synthetic construct
  misc_feature 1..32: note = synthetic oligonucleotide
  source 1..32: mol_type = other DNA
cgacagacgcctgatctctggtaaagtggctt

SEQ ID NO: 1119 - DNA, 25 bp, synthetic construct
  misc_feature 1..25: note = synthetic oligonucleotide
  source 1..25: mol_type = other DNA
gatcaagccactttaccagagatca

SEQ ID NO: 1120 - DNA, 32 bp, synthetic construct
  misc_feature 1..32: note = synthetic oligonucleotide
  source 1..32: mol_type = other DNA
cgacagacgcctgatctctggatcaaacggtt

SEQ ID NO: 1121 - DNA, 25 bp, synthetic construct
  misc_feature 1..25: note = synthetic oligonucleotide
  source 1..25: mol_type = other DNA
gatcaaccgtttgatccagagatca

SEQ ID NO: 1122 - DNA, 32 bp, synthetic construct
  misc_feature 1..32: note = synthetic oligonucleotide
  source 1..32: mol_type = other DNA
cgacagacgcctgatctctgctaagaaccgtt

SEQ ID NO: 1123 - DNA, 25 bp, synthetic construct
  misc_feature 1..25: note = synthetic oligonucleotide
  source 1..25: mol_type = other DNA
gatcaacggttcttagcagagatca

SEQ ID NO: 1124 - DNA, 32 bp, synthetic construct
  misc_feature 1..32: note = synthetic oligonucleotide
  source 1..32: mol_type = other DNA
cgacagacgcctgatctctgcataacgaggtt

SEQ ID NO: 1125 - DNA, 25 bp, synthetic construct
  misc_feature 1..25: note = synthetic oligonucleotide
  source 1..25: mol_type = other DNA
gatcaacctcgttatgcagagatca

SEQ ID NO: 1126 - DNA, 32 bp, synthetic construct
  misc_feature 1..32: note = synthetic oligonucleotide
  source 1..32: mol_type = other DNA
cgacagacgcctgatctctgcagaaaggagtt

SEQ ID NO: 1127 - DNA, 25 bp, synthetic construct
  misc_feature 1..25: note = synthetic oligonucleotide
  source 1..25: mol_type = other DNA
gatcaactcctttctgcagagatca

SEQ ID NO: 1128 - DNA, 32 bp, synthetic construct
  misc_feature 1..32: note = synthetic oligonucleotide
  source 1..32: mol_type = other DNA
cgacagacgcctgatctctgacaggtggaaat

SEQ ID NO: 1129 - DNA, 25 bp, synthetic construct
  misc_feature 1..25: note = synthetic oligonucleotide
  source 1..25: mol_type = other DNA
gatcatttccacctgtcagagatca

SEQ ID NO: 1130 - DNA, 32 bp, synthetic construct
  misc_feature 1..32: note = synthetic oligonucleotide
  source 1..32: mol_type = other DNA
cgacagacgcctgatctctgaataaggcggat

SEQ ID NO: 1131 - DNA, 25 bp, synthetic construct
  misc_feature 1..25: note = synthetic oligonucleotide
  source 1..25: mol_type = other DNA
gatcatccgccttattcagagatca

SEQ ID NO: 1132 - DNA, 32 bp, synthetic construct
  misc_feature 1..32: note = synthetic oligonucleotide
  source 1..32: mol_type = other DNA
cgacagacgcctgatctctgaacttggtggtt

SEQ ID NO: 1133 - DNA, 25 bp, synthetic construct
  misc_feature 1..25: note = synthetic oligonucleotide
  source 1..25: mol_type = other DNA
gatcaaccaccaagttcagagatca

SEQ ID NO: 1134 - DNA, 32 bp, synthetic construct
  misc_feature 1..32: note = synthetic oligonucleotide
  source 1..32: mol_type = other DNA
cgacagacgcctgatctctgaaccgcctaaat

SEQ ID NO: 1135 - DNA, 25 bp, synthetic construct
  misc_feature 1..25: note = synthetic oligonucleotide
  source 1..25: mol_type = other DNA
gatcatttaggcggttcagagatca

SEQ ID NO: 1136 - DNA, 32 bp, synthetic construct
  misc_feature 1..32: note = synthetic oligonucleotide
  source 1..32: mol_type = other DNA
cgacagacgcctgatctctgaaataccgcctt

SEQ ID NO: 1137 - DNA, 25 bp, synthetic construct
  misc_feature 1..25: note = synthetic oligonucleotide
  source 1..25: mol_type = other DNA
gatcaaggcggtatttcagagatca

SEQ ID NO: 1138 - DNA, 32 bp, synthetic construct
  misc_feature 1..32: note = synthetic oligonucleotide
  source 1..32: mol_type = other DNA
cgacagacgcctgatctctctccgaaactgtt

SEQ ID NO: 1139 - DNA, 25 bp, synthetic construct
  misc_feature 1..25: note = synthetic oligonucleotide
  source 1..25: mol_type = other DNA
gatcaacagtttcggagagagatca

SEQ ID NO: 1140 - DNA, 32 bp, synthetic construct
  misc_feature 1..32: note = synthetic oligonucleotide
  source 1..32: mol_type = other DNA
cgacagacgcctgatctctcgttgtaatgcct

SEQ ID NO: 1141 - DNA, 25 bp, synthetic construct
  misc_feature 1..25: note = synthetic oligonucleotide
  source 1..25: mol_type = other DNA
gatcaggcattacaacgagagatca

SEQ ID NO: 1142 - DNA, 32 bp, synthetic construct
  misc_feature 1..32: note = synthetic oligonucleotide
  source 1..32: mol_type = other DNA
cgacagacgcctgatctctcgacaaagaggtt

SEQ ID NO: 1143 - DNA, 25 bp, synthetic construct
  misc_feature 1..25: note = synthetic oligonucleotide
  source 1..25: mol_type = other DNA
gatcaacctctttgtcgagagatca

SEQ ID NO: 1144 - DNA, 32 bp, synthetic construct
  misc_feature 1..32: note = synthetic oligonucleotide
  source 1..32: mol_type = other DNA
cgacagacgcctgatctctcgaatcaagcctt

SEQ ID NO: 1145 - DNA, 25 bp, synthetic construct
  misc_feature 1..25: note = synthetic oligonucleotide
  source 1..25: mol_type = other DNA
gatcaaggcttgattcgagagatca

SEQ ID NO: 1146 - DNA, 32 bp, synthetic construct
  misc_feature 1..32: note = synthetic oligonucleotide
  source 1..32: mol_type = other DNA
cgacagacgcctgatctctccggaaacacttt

SEQ ID NO: 1147 - DNA, 25 bp, synthetic construct
  misc_feature 1..25: note = synthetic oligonucleotide
  source 1..25: mol_type = other DNA
gatcaaagtgtttccggagagatca

SEQ ID NO: 1148 - DNA, 32 bp, synthetic construct
  misc_feature 1..32: note = synthetic oligonucleotide
  source 1..32: mol_type = other DNA
cgacagacgcctgatctctccaaacgagctat

SEQ ID NO: 1149 - DNA, 25 bp, synthetic construct
  misc_feature 1..25: note = synthetic oligonucleotide
  source 1..25: mol_type = other DNA
gatcatagctcgtttggagagatca

SEQ ID NO: 1150 - DNA, 32 bp, synthetic construct
  misc_feature 1..32: note = synthetic oligonucleotide
  source 1..32: mol_type = other DNA
cgacagacgcctgatctctcatttgtacggct

SEQ ID NO: 1151 - DNA, 25 bp, synthetic construct
  misc_feature 1..25: note = synthetic oligonucleotide
  source 1..25: mol_type = other DNA
gatcagccgtacaaatgagagatca

SEQ ID NO: 1152 - DNA, 32 bp, synthetic construct
  misc_feature 1..32: note = synthetic oligonucleotide
  source 1..32: mol_type = other DNA
cgacagacgcctgatctctcatcatttcggct

SEQ ID NO: 1153 - DNA, 25 bp, synthetic construct
  misc_feature 1..25: note = synthetic oligonucleotide
  source 1..25: mol_type = other DNA
gatcagccgaaatgatgagagatca

SEQ ID NO: 1154 - DNA, 32 bp, synthetic construct
  misc_feature 1..32: note = synthetic oligonucleotide
  source 1..32: mol_type = other DNA
cgacagacgcctgatctctcagaatgccacat

SEQ ID NO: 1155 - DNA, 25 bp, synthetic construct
  misc_feature 1..25: note = synthetic oligonucleotide
  source 1..25: mol_type = other DNA
gatcatgtggcattctgagagatca

SEQ ID NO: 1156 - DNA, 32 bp, synthetic construct
  misc_feature 1..32: note = synthetic oligonucleotide
  source 1..32: mol_type = other DNA
cgacagacgcctgatctctcaatcaggcacat

SEQ ID NO: 1157 - DNA, 25 bp, synthetic construct
  misc_feature 1..25: note = synthetic oligonucleotide
  source 1..25: mol_type = other DNA
gatcatgtgcctgattgagagatca

SEQ ID NO: 1158 - DNA, 32 bp, synthetic construct
  misc_feature 1..32: note = synthetic oligonucleotide
  source 1..32: mol_type = other DNA
cgacagacgcctgatctctcaacggtcttctt

SEQ ID NO: 1159 - DNA, 25 bp, synthetic construct
  misc_feature 1..25: note = synthetic oligonucleotide
  source 1..25: mol_type = other DNA
gatcaagaagaccgttgagagatca

SEQ ID NO: 1160 - DNA, 32 bp, synthetic construct
  misc_feature 1..32: note = synthetic oligonucleotide
  source 1..32: mol_type = other DNA
cgacagacgcctgatctctattgccacgactt

SEQ ID NO: 1161 - DNA, 25 bp, synthetic construct
  misc_feature 1..25: note = synthetic oligonucleotide
  source 1..25: mol_type = other DNA
gatcaagtcgtggcaatagagatca

SEQ ID NO: 1162 - DNA, 32 bp, synthetic construct
  misc_feature 1..32: note = synthetic oligonucleotide
  source 1..32: mol_type = other DNA
cgacagacgcctgatctctatgtttcacggct

SEQ ID NO: 1163 - DNA, 25 bp, synthetic construct
  misc_feature 1..25: note = synthetic oligonucleotide
  source 1..25: mol_type = other DNA
gatcagccgtgaaacatagagatca

SEQ ID NO: 1164 - DNA, 32 bp, synthetic construct
  misc_feature 1..32: note = synthetic oligonucleotide
  source 1..32: mol_type = other DNA
cgacagacgcctgatctctatcttggtgcgat

SEQ ID NO: 1165 - DNA, 25 bp, synthetic construct
  misc_feature 1..25: note = synthetic oligonucleotide
  source 1..25: mol_type = other DNA
gatcatcgcaccaagatagagatca

SEQ ID NO: 1166 - DNA, 32 bp, synthetic construct
  misc_feature 1..32: note = synthetic oligonucleotide
  source 1..32: mol_type = other DNA
cgacagacgcctgatctctagttggtgcagtt

SEQ ID NO: 1167 - DNA, 25 bp, synthetic construct
  misc_feature 1..25: note = synthetic oligonucleotide
  source 1..25: mol_type = other DNA
gatcaactgcaccaactagagatca

SEQ ID NO: 1168 - DNA, 32 bp, synthetic construct
  misc_feature 1..32: note = synthetic oligonucleotide
  source 1..32: mol_type = other DNA
cgacagacgcctgatctctagtggcaaggttt

SEQ ID NO: 1169 - DNA, 25 bp, synthetic construct
  misc_feature 1..25: note = synthetic oligonucleotide
  source 1..25: mol_type = other DNA
gatcaaaccttgccactagagatca

SEQ ID NO: 1170 - DNA, 32 bp, synthetic construct
  misc_feature 1..32: note = synthetic oligonucleotide
  source 1..32: mol_type = other DNA
cgacagacgcctgatctctaggtaaacggcat

SEQ ID NO: 1171 - DNA, 25 bp, synthetic construct
  misc_feature 1..25: note = synthetic oligonucleotide
  source 1..25: mol_type = other DNA
gatcatgccgtttacctagagatca

SEQ ID NO: 1172 - DNA, 32 bp, synthetic construct
  misc_feature 1..32: note = synthetic oligonucleotide
  source 1..32: mol_type = other DNA
cgacagacgcctgatctctagagtgtgcgttt

SEQ ID NO: 1173 - DNA, 25 bp, synthetic construct
  misc_feature 1..25: note = synthetic oligonucleotide
  source 1..25: mol_type = other DNA
gatcaaacgcacactctagagatca

SEQ ID NO: 1174 - DNA, 32 bp, synthetic construct
  misc_feature 1..32: note = synthetic oligonucleotide
  source 1..32: mol_type = other DNA
cgacagacgcctgatctctactgcgaaacact

SEQ ID NO: 1175 - DNA, 25 bp, synthetic construct
  misc_feature 1..25: note = synthetic oligonucleotide
  source 1..25: mol_type = other DNA
gatcagtgtttcgcagtagagatca

SEQ ID NO: 1176 - DNA, 32 bp, synthetic construct
  misc_feature 1..32: note = synthetic oligonucleotide
  source 1..32: mol_type = other DNA
cgacagacgcctgatctctaatcacggcaact

SEQ ID NO: 1177 - DNA, 25 bp, synthetic construct
  misc_feature 1..25: note = synthetic oligonucleotide
  source 1..25: mol_type = other DNA
gatcagttgccgtgattagagatca

SEQ ID NO: 1178 - DNA, 32 bp, synthetic construct
  misc_feature 1..32: note = synthetic oligonucleotide
  source 1..32: mol_type = other DNA
cgacagacgcctgatctctaagttgcgaggat

SEQ ID NO: 1179 - DNA, 25 bp, synthetic construct
  misc_feature 1..25: note = synthetic oligonucleotide
  source 1..25: mol_type = other DNA
gatcatcctcgcaacttagagatca

SEQ ID NO: 1180 - DNA, 32 bp, synthetic construct
  misc_feature 1..32: note = synthetic oligonucleotide
  source 1..32: mol_type = other DNA
cgacagacgcctgatctctaagtgctggtgtt

SEQ ID NO: 1181 - DNA, 25 bp, synthetic construct
  misc_feature 1..25: note = synthetic oligonucleotide
  source 1..25: mol_type = other DNA
gatcaacaccagcacttagagatca

SEQ ID NO: 1182 - DNA, 32 bp, synthetic construct
  misc_feature 1..32: note = synthetic oligonucleotide
  source 1..32: mol_type = other DNA
cgacagacgcctgatctctaaggaactgcgat

SEQ ID NO: 1183 - DNA, 25 bp, synthetic construct
  misc_feature 1..25: note = synthetic oligonucleotide
  source 1..25: mol_type = other DNA
gatcatcgcagttccttagagatca

SEQ ID NO: 1184 - DNA, 32 bp, synthetic construct
  misc_feature 1..32: note = synthetic oligonucleotide
  source 1..32: mol_type = other DNA
cgacagacgcctgatctctaaatgtccacgct

SEQ ID NO: 1185 - DNA, 25 bp, synthetic construct
  misc_feature 1..25: note = synthetic oligonucleotide
  source 1..25: mol_type = other DNA
gatcagcgtggacatttagagatca

SEQ ID NO: 1186 - DNA, 32 bp, synthetic construct
  misc_feature 1..32: note = synthetic oligonucleotide
  source 1..32: mol_type = other DNA
cgacagacgcctgatctctaaatcgccaacgt

SEQ ID NO: 1187 - DNA, 25 bp, synthetic construct
  misc_feature 1..25: note = synthetic oligonucleotide
  source 1..25: mol_type = other DNA
gatcacgttggcgatttagagatca

SEQ ID NO: 1188 - DNA, 32 bp, synthetic construct
  misc_feature 1..32: note = synthetic oligonucleotide
  source 1..32: mol_type = other DNA
cgacagacgcctgatctctaaatacgtgcggt

SEQ ID NO: 1189 - DNA, 25 bp, synthetic construct
  misc_feature 1..25: note = synthetic oligonucleotide
  source 1..25: mol_type = other DNA
gatcaccgcacgtatttagagatca

SEQ ID NO: 1190 - DNA, 32 bp, synthetic construct
  misc_feature 1..32: note = synthetic oligonucleotide
  source 1..32: mol_type = other DNA
cgacagacgcctgatctctaaaggcgatggtt

SEQ ID NO: 1191 - DNA, 25 bp, synthetic construct
  misc_feature 1..25: note = synthetic oligonucleotide
  source 1..25: mol_type = other DNA
gatcaaccatcgcctttagagatca

SEQ ID NO: 1192 - DNA, 32 bp, synthetic construct
  misc_feature 1..32: note = synthetic oligonucleotide
  source 1..32: mol_type = other DNA
cgacagacgcctgatctcgtttggaatggtct

SEQ ID NO: 1193 - DNA, 25 bp, synthetic construct
  misc_feature 1..25: note = synthetic oligonucleotide
  source 1..25: mol_type = other DNA
gatcagaccattccaaacgagatca

SEQ ID NO: 1194 - DNA, 32 bp, synthetic construct
  misc_feature 1..32: note = synthetic oligonucleotide
  source 1..32: mol_type = other DNA
cgacagacgcctgatctcgtttctcacaggtt

SEQ ID NO: 1195 - DNA, 25 bp, synthetic construct
  misc_feature 1..25: note = synthetic oligonucleotide
  source 1..25: mol_type = other DNA
gatcaacctgtgagaaacgagatca

SEQ ID NO: 1196 - DNA, 32 bp, synthetic construct
  misc_feature 1..32: note = synthetic oligonucleotide
  source 1..32: mol_type = other DNA
cgacagacgcctgatctcgtttcgaggtagtt

SEQ ID NO: 1197 - DNA, 25 bp, synthetic construct
  misc_feature 1..25: note = synthetic oligonucleotide
  source 1..25: mol_type = other DNA
gatcaactacctcgaaacgagatca

SEQ ID NO: 1198 - DNA, 32 bp, synthetic construct
  misc_feature 1..32: note = synthetic oligonucleotide
  source 1..32: mol_type = other DNA
cgacagacgcctgatctcgtttacgatgtggt

SEQ ID NO: 1199 - DNA, 25 bp, synthetic construct
  misc_feature 1..25: note = synthetic oligonucleotide
  source 1..25: mol_type = other DNA
gatcaccacatcgtaaacgagatca

SEQ ID NO: 1200 - DNA, 32 bp, synthetic construct
  misc_feature 1..32: note = synthetic oligonucleotide
  source 1..32: mol_type = other DNA
cgacagacgcctgatctcgttgtgtgaagtct

SEQ ID NO: 1201 - DNA, 25 bp, synthetic construct
  misc_feature 1..25: note = synthetic oligonucleotide
  source 1..25: mol_type = other DNA
gatcagacttcacacaacgagatca

SEQ ID NO: 1202 - DNA, 32 bp, synthetic construct
  misc_feature 1..32: note = synthetic oligonucleotide
  source 1..32: mol_type = other DNA
cgacagacgcctgatctcgttggtaattcggt

SEQ ID NO: 1203 - DNA, 25 bp, synthetic construct
  misc_feature 1..25: note = synthetic oligonucleotide
  source 1..25: mol_type = other DNA
gatcaccgaattaccaacgagatca

SEQ ID NO: 1204 - DNA, 32 bp, synthetic construct
  misc_feature 1..32: note = synthetic oligonucleotide
  source 1..32: mol_type = other DNA
cgacagacgcctgatctcgttggaatctggtt

SEQ ID NO: 1205 - DNA, 25 bp, synthetic construct
  misc_feature 1..25: note = synthetic oligonucleotide
  source 1..25: mol_type = other DNA
gatcaaccagattccaacgagatca

SEQ ID NO: 1206 - DNA, 32 bp, synthetic construct
  misc_feature 1..32: note = synthetic oligonucleotide
  source 1..32: mol_type = other DNA
cgacagacgcctgatctcgttggaagacagat

SEQ ID NO: 1207 - DNA, 25 bp, synthetic construct
  misc_feature 1..25: note = synthetic oligonucleotide
  source 1..25: mol_type = other DNA
gatcatctgtcttccaacgagatca

SEQ ID NO: 1208 - DNA, 32 bp, synthetic construct
  misc_feature 1..32: note = synthetic oligonucleotide
  source 1..32: mol_type = other DNA
cgacagacgcctgatctcgttcgttaggtgat

SEQ ID NO: 1209 - DNA, 25 bp, synthetic construct
  misc_feature 1..25: note = synthetic oligonucleotide
  source 1..25: mol_type = other DNA
gatcatcacctaacgaacgagatca

SEQ ID NO: 1210 - DNA, 32 bp, synthetic construct
  misc_feature 1..32: note = synthetic oligonucleotide
  source 1..32: mol_type = other DNA
cgacagacgcctgatctcgttcctcaacagat

SEQ ID NO: 1211 - DNA, 25 bp, synthetic construct
  misc_feature 1..25: note = synthetic oligonucleotide
  source 1..25: mol_type = other DNA
gatcatctgttgaggaacgagatca

SEQ ID NO: 1212 - DNA, 32 bp, synthetic construct
  misc_feature 1..32: note = synthetic oligonucleotide
  source 1..32: mol_type = other DNA
cgacagacgcctgatctcgttcatttccgagt

SEQ ID NO: 1213 - DNA, 25 bp, synthetic construct
  misc_feature 1..25: note = synthetic oligonucleotide
  source 1..25: mol_type = other DNA
gatcactcggaaatgaacgagatca

SEQ ID NO: 1214 - DNA, 32 bp, synthetic construct
  misc_feature 1..32: note = synthetic oligonucleotide
  source 1..32: mol_type = other DNA
cgacagacgcctgatctcgttcaactactgct

SEQ ID NO: 1215 - DNA, 25 bp, synthetic construct
  misc_feature 1..25: note = synthetic oligonucleotide
  source 1..25: mol_type = other DNA
gatcagcagtagttgaacgagatca

SEQ ID NO: 1216 - DNA, 32 bp, synthetic construct
  misc_feature 1..32: note = synthetic oligonucleotide
  source 1..32: mol_type = other DNA
cgacagacgcctgatctcgttatggatgtgct

SEQ ID NO: 1217 - DNA, 25 bp, synthetic construct
  misc_feature 1..25: note = synthetic oligonucleotide
  source 1..25: mol_type = other DNA
gatcagcacatccataacgagatca

SEQ ID NO: 1218 - DNA, 32 bp, synthetic construct
  misc_feature 1..32: note = synthetic oligonucleotide
  source 1..32: mol_type = other DNA
cgacagacgcctgatctcgttaagtctcggtt

SEQ ID NO: 1219 - DNA, 25 bp, synthetic construct
  misc_feature 1..25: note = synthetic oligonucleotide
  source 1..25: mol_type = other DNA
gatcaaccgagacttaacgagatca

SEQ ID NO: 1220 - DNA, 32 bp, synthetic construct
  misc_feature 1..32: note = synthetic oligonucleotide
  source 1..32: mol_type = other DNA
cgacagacgcctgatctcgtgtttaggtcgat

SEQ ID NO: 1221 - DNA, 25 bp, synthetic construct
  misc_feature 1..25: note = synthetic oligonucleotide
  source 1..25: mol_type = other DNA
gatcatcgacctaaacacgagatca

SEQ ID NO: 1222 - DNA, 32 bp, synthetic construct
  misc_feature 1..32: note = synthetic oligonucleotide
  source 1..32: mol_type = other DNA
cgacagacgcctgatctcgtggcaataaaggt

SEQ ID NO: 1223 - DNA, 25 bp, synthetic construct
  misc_feature 1..25: note = synthetic oligonucleotide
  source 1..25: mol_type = other DNA
gatcacctttattgccacgagatca

SEQ ID NO: 1224 - DNA, 32 bp, synthetic construct
  misc_feature 1..32: note = synthetic oligonucleotide
  source 1..32: mol_type = other DNA
cgacagacgcctgatctcgtggaaacaggatt

SEQ ID NO: 1225 - DNA, 25 bp, synthetic construct
  misc_feature 1..25: note = synthetic oligonucleotide
  source 1..25: mol_type = other DNA
gatcaatcctgtttccacgagatca

SEQ ID NO: 1226 - DNA, 32 bp, synthetic construct
  misc_feature 1..32: note = synthetic oligonucleotide
  source 1..32: mol_type = other DNA
cgacagacgcctgatctcgtgacatttggtgt

SEQ ID NO: 1227 - DNA, 25 bp, synthetic construct
  misc_feature 1..25: note = synthetic oligonucleotide
  source 1..25: mol_type = other DNA
gatcacaccaaatgtcacgagatca

SEQ ID NO: 1228 - DNA, 32 bp, synthetic construct
  misc_feature 1..32: note = synthetic oligonucleotide
  source 1..32: mol_type = other DNA
cgacagacgcctgatctcgtatatcgcacctt

SEQ ID NO: 1229 - DNA, 25 bp, synthetic construct
  misc_feature 1..25: note = synthetic oligonucleotide
  source 1..25: mol_type = other DNA
gatcaaggtgcgatatacgagatca

SEQ ID NO: 1230 - DNA, 32 bp, synthetic construct
  misc_feature 1..32: note = synthetic oligonucleotide
  source 1..32: mol_type = other DNA
cgacagacgcctgatctcgtataaggtcgcat

SEQ ID NO: 1231 - DNA, 25 bp, synthetic construct
  misc_feature 1..25: note = synthetic oligonucleotide
  source 1..25: mol_type = other DNA
gatcatgcgaccttatacgagatca

SEQ ID NO: 1232 - DNA, 32 bp, synthetic construct
  misc_feature 1..32: note = synthetic oligonucleotide
  source 1..32: mol_type = other DNA
cgacagacgcctgatctcgtagtaaagcggat

SEQ ID NO: 1233 - DNA, 25 bp, synthetic construct
  misc_feature 1..25: note = synthetic oligonucleotide
  source 1..25: mol_type = other DNA
gatcatccgctttactacgagatca

SEQ ID NO: 1234 - DNA, 32 bp, synthetic construct
  misc_feature 1..32: note = synthetic oligonucleotide
  source 1..32: mol_type = other DNA
cgacagacgcctgatctcgtaatgacgaagct

SEQ ID NO: 1235 - DNA, 25 bp, synthetic construct
  misc_feature 1..25: note = synthetic oligonucleotide
  source 1..25: mol_type = other DNA
gatcagcttcgtcattacgagatca

SEQ ID NO: 1236 - DNA, 32 bp, synthetic construct
  misc_feature 1..32: note = synthetic oligonucleotide
  source 1..32: mol_type = other DNA
cgacagacgcctgatctcgtaacataacggct

SEQ ID NO: 1237 - DNA, 25 bp, synthetic construct
  misc_feature 1..25: note = synthetic oligonucleotide
  source 1..25: mol_type = other DNA
gatcagccgttatgttacgagatca

SEQ ID NO: 1238 - DNA, 32 bp, synthetic construct
  misc_feature 1..32: note = synthetic oligonucleotide
  source 1..32: mol_type = other DNA
cgacagacgcctgatctcgtaacaagcactct

SEQ ID NO: 1239 - DNA, 25 bp, synthetic construct
  misc_feature 1..25: note = synthetic oligonucleotide
  source 1..25: mol_type = other DNA
gatcagagtgcttgttacgagatca

SEQ ID NO: 1240 - DNA, 32 bp, synthetic construct
  misc_feature 1..32: note = synthetic oligonucleotide
  source 1..32: mol_type = other DNA
cgacagacgcctgatctcgtaaatgcggaagt

SEQ ID NO: 1241 - DNA, 25 bp, synthetic construct
  misc_feature 1..25: note = synthetic oligonucleotide
  source 1..25: mol_type = other DNA
gatcacttccgcatttacgagatca

SEQ ID NO: 1242 - DNA, 32 bp, synthetic construct
  misc_feature 1..32: note = synthetic oligonucleotide
  source 1..32: mol_type = other DNA
cgacagacgcctgatctcgtaaagtcggagat

SEQ ID NO: 1243 - DNA, 25 bp, synthetic construct
  misc_feature 1..25: note = synthetic oligonucleotide
  source 1..25: mol_type = other DNA
gatcatctccgactttacgagatca

SEQ ID NO: 1244 - DNA, 32 bp, synthetic construct
  misc_feature 1..32: note = synthetic oligonucleotide
  source 1..32: mol_type = other DNA
cgacagacgcctgatctcgtaaacaggagctt

SEQ ID NO: 1245 - DNA, 25 bp, synthetic construct
  misc_feature 1..25: note = synthetic oligonucleotide
  source 1..25: mol_type = other DNA
gatcaagctcctgtttacgagatca

SEQ ID NO: 1246 - DNA, 32 bp, synthetic construct
  misc_feature 1..32: note = synthetic oligonucleotide
  source 1..32: mol_type = other DNA
cgacagacgcctgatctcggttgtattcggat

SEQ ID NO: 1247 - DNA, 25 bp, synthetic construct
  misc_feature 1..25: note = synthetic oligonucleotide
  source 1..25: mol_type = other DNA
gatcatccgaatacaaccgagatca

SEQ ID NO: 1248 - DNA, 32 bp, synthetic construct
  misc_feature 1..32: note = synthetic oligonucleotide
  source 1..32: mol_type = other DNA
cgacagacgcctgatctcggttatttcgagct

SEQ ID NO: 1249 - DNA, 25 bp, synthetic construct
  misc_feature 1..25: note = synthetic oligonucleotide
  source 1..25: mol_type = other DNA
gatcagctcgaaataaccgagatca

SEQ ID NO: 1250 - DNA, 32 bp, synthetic construct
  misc_feature 1..32: note = synthetic oligonucleotide
  source 1..32: mol_type = other DNA
cgacagacgcctgatctcggtgttaatgtgct

SEQ ID NO: 1251 - DNA, 25 bp, synthetic construct
  misc_feature 1..25: note = synthetic oligonucleotide
  source 1..25: mol_type = other DNA
gatcagcacattaacaccgagatca

SEQ ID NO: 1252 - DNA, 32 bp, synthetic construct
  misc_feature 1..32: note = synthetic oligonucleotide
  source 1..32: mol_type = other DNA
cgacagacgcctgatctcggtatacaaggcat

SEQ ID NO: 1253 - DNA, 25 bp, synthetic construct
  misc_feature 1..25: note = synthetic oligonucleotide
  source 1..25: mol_type = other DNA
gatcatgccttgtataccgagatca

SEQ ID NO: 1254 - DNA, 32 bp, synthetic construct
  misc_feature 1..32: note = synthetic oligonucleotide
  source 1..32: mol_type = other DNA
cgacagacgcctgatctcggtaagtttgtgct

SEQ ID NO: 1255 - DNA, 25 bp, synthetic construct
  misc_feature 1..25: note = synthetic oligonucleotide
  source 1..25: mol_type = other DNA
gatcagcacaaacttaccgagatca

SEQ ID NO: 1256 - DNA, 32 bp, synthetic construct
  misc_feature 1..32: note = synthetic oligonucleotide
  source 1..32: mol_type = other DNA
cgacagacgcctgatctcggtaacaacctgat

SEQ ID NO: 1257 - DNA, 25 bp, synthetic construct
  misc_feature 1..25: note = synthetic oligonucleotide
  source 1..25: mol_type = other DNA
gatcatcaggttgttaccgagatca

SEQ ID NO: 1258 - DNA, 32 bp, synthetic construct
  misc_feature 1..32: note = synthetic oligonucleotide
  source 1..32: mol_type = other DNA
cgacagacgcctgatctcggcgaatttatggt

SEQ ID NO: 1259 - DNA, 25 bp, synthetic construct
  misc_feature 1..25: note = synthetic oligonucleotide
  source 1..25: mol_type = other DNA
gatcaccataaattcgccgagatca

SEQ ID NO: 1260 - DNA, 32 bp, synthetic construct
  misc_feature 1..32: note = synthetic oligonucleotide
  source 1..32: mol_type = other DNA
cgacagacgcctgatctcggatcacctttgtt

SEQ ID NO: 1261 - DNA, 25 bp, synthetic construct
  misc_feature 1..25: note = synthetic oligonucleotide
  source 1..25: mol_type = other DNA
gatcaacaaaggtgatccgagatca

SEQ ID NO: 1262 - DNA, 32 bp, synthetic construct
  misc_feature 1..32: note = synthetic oligonucleotide
  source 1..32: mol_type = other DNA
cgacagacgcctgatctcggaacacacctatt

SEQ ID NO: 1263 - DNA, 25 bp, synthetic construct
  misc_feature 1..25: note = synthetic oligonucleotide
  source 1..25: mol_type = other DNA
gatcaataggtgtgttccgagatca

SEQ ID NO: 1264 - DNA, 32 bp, synthetic construct
  misc_feature 1..32: note = synthetic oligonucleotide
  source 1..32: mol_type = other DNA
cgacagacgcctgatctcgcttatctgtggat

SEQ ID NO: 1265 - DNA, 25 bp, synthetic construct
  misc_feature 1..25: note = synthetic oligonucleotide
  source 1..25: mol_type = other DNA
gatcatccacagataagcgagatca

SEQ ID NO: 1266 - DNA, 32 bp, synthetic construct
  misc_feature 1..32: note = synthetic oligonucleotide
  source 1..32: mol_type = other DNA
cgacagacgcctgatctcgcgatgtttaaggt

SEQ ID NO: 1267 - DNA, 25 bp, synthetic construct
  misc_feature 1..25: note = synthetic oligonucleotide
  source 1..25: mol_type = other DNA
gatcaccttaaacatcgcgagatca

SEQ ID NO: 1268 - DNA, 32 bp, synthetic construct
  misc_feature 1..32: note = synthetic oligonucleotide
  source 1..32: mol_type = other DNA
cgacagacgcctgatctcgcctttaaccttgt

SEQ ID NO: 1269 - DNA, 25 bp, synthetic construct
  misc_feature 1..25: note = synthetic oligonucleotide
  source 1..25: mol_type = other DNA
gatcacaaggttaaaggcgagatca

SEQ ID NO: 1270 - DNA, 32 bp, synthetic construct
  misc_feature 1..32: note = synthetic oligonucleotide
  source 1..32: mol_type = other DNA
cgacagacgcctgatctcgccaaagaggtatt

SEQ ID NO: 1271 - DNA, 25 bp, synthetic construct
  misc_feature 1..25: note = synthetic oligonucleotide
  source 1..25: mol_type = other DNA
gatcaatacctctttggcgagatca

SEQ ID NO: 1272 - DNA, 32 bp, synthetic construct
  misc_feature 1..32: note = synthetic oligonucleotide
  source 1..32: mol_type = other DNA
cgacagacgcctgatctcgatttggttacggt

SEQ ID NO: 1273 - DNA, 25 bp, synthetic construct
  misc_feature 1..25: note = synthetic oligonucleotide
  source 1..25: mol_type = other DNA
gatcaccgtaaccaaatcgagatca

SEQ ID NO: 1274 - DNA, 32 bp, synthetic construct
  misc_feature 1..32: note = synthetic oligonucleotide
  source 1..32: mol_type = other DNA
cgacagacgcctgatctcgatctggtttggat

SEQ ID NO: 1275 - DNA, 25 bp, synthetic construct
  misc_feature 1..25: note = synthetic oligonucleotide
  source 1..25: mol_type = other DNA
gatcatccaaaccagatcgagatca

SEQ ID NO: 1276 - DNA, 32 bp, synthetic construct
  misc_feature 1..32: note = synthetic oligonucleotide
  source 1..32: mol_type = other DNA
cgacagacgcctgatctcgaggcaaataggtt

SEQ ID NO: 1277 - DNA, 25 bp, synthetic construct
  misc_feature 1..25: note = synthetic oligonucleotide
  source 1..25: mol_type = other DNA
gatcaacctatttgcctcgagatca

SEQ ID NO: 1278 - DNA, 32 bp, synthetic construct
  misc_feature 1..32: note = synthetic oligonucleotide
  source 1..32: mol_type = other DNA
cgacagacgcctgatctcgaatgtgtgactgt

SEQ ID NO: 1279 - DNA, 25 bp, synthetic construct
  misc_feature 1..25: note = synthetic oligonucleotide
  source 1..25: mol_type = other DNA
gatcacagtcacacattcgagatca

SEQ ID NO: 1280 - DNA, 32 bp, synthetic construct
  misc_feature 1..32: note = synthetic oligonucleotide
  source 1..32: mol_type = other DNA
cgacagacgcctgatctcgaacttctggtgat

SEQ ID NO: 1281 - DNA, 25 bp, synthetic construct
  misc_feature 1..25: note = synthetic oligonucleotide
  source 1..25: mol_type = other DNA
gatcatcaccagaagttcgagatca

SEQ ID NO: 1282 - DNA, 32 bp, synthetic construct
  misc_feature 1..32: note = synthetic oligonucleotide
  source 1..32: mol_type = other DNA
cgacagacgcctgatctcgaaatctaggcgat

SEQ ID NO: 1283 - DNA, 25 bp, synthetic construct
  misc_feature 1..25: note = synthetic oligonucleotide
  source 1..25: mol_type = other DNA
gatcatcgcctagatttcgagatca

SEQ ID NO: 1284 - DNA, 32 bp, synthetic construct
  misc_feature 1..32: note = synthetic oligonucleotide
  source 1..32: mol_type = other DNA
cgacagacgcctgatctcgaaacagtggagtt

SEQ ID NO: 1285 - DNA, 25 bp, synthetic construct
  misc_feature 1..25: note = synthetic oligonucleotide
  source 1..25: mol_type = other DNA
gatcaactccactgtttcgagatca

SEQ ID NO: 1286 - DNA, 32 bp, synthetic construct
  misc_feature 1..32: note = synthetic oligonucleotide
  source 1..32: mol_type = other DNA
cgacagacgcctgatctcctttcagtgtccat

SEQ ID NO: 1287 - DNA, 25 bp, synthetic construct
  misc_feature 1..25: note = synthetic oligonucleotide
  source 1..25: mol_type = other DNA
gatcatggacactgaaaggagatca

SEQ ID NO: 1288 - DNA, 32 bp, synthetic construct
  misc_feature 1..32: note = synthetic oligonucleotide
  source 1..32: mol_type = other DNA
cgacagacgcctgatctcctttaaggagcgat

SEQ ID NO: 1289 - DNA, 25 bp, synthetic construct
  misc_feature 1..25: note = synthetic oligonucleotide
  source 1..25: mol_type = other DNA
gatcatcgctccttaaaggagatca

SEQ ID NO: 1290 - DNA, 32 bp, synthetic construct
  misc_feature 1..32: note = synthetic oligonucleotide
  source 1..32: mol_type = other DNA
cgacagacgcctgatctccttctattcggcat

SEQ ID NO: 1291 - DNA, 25 bp, synthetic construct
  misc_feature 1..25: note = synthetic oligonucleotide
  source 1..25: mol_type = other DNA
gatcatgccgaatagaaggagatca

SEQ ID NO: 1292 - DNA, 32 bp, synthetic construct
  misc_feature 1..32: note = synthetic oligonucleotide
  source 1..32: mol_type = other DNA
cgacagacgcctgatctccttattccagcgtt

SEQ ID NO: 1293 - DNA, 25 bp, synthetic construct
  misc_feature 1..25: note = synthetic oligonucleotide
  source 1..25: mol_type = other DNA
gatcaacgctggaataaggagatca

SEQ ID NO: 1294 - DNA, 32 bp, synthetic construct
  misc_feature 1..32: note = synthetic oligonucleotide
  source 1..32: mol_type = other DNA
cgacagacgcctgatctccttaactttgccgt

SEQ ID NO: 1295 - DNA, 25 bp, synthetic construct
  misc_feature 1..25: note = synthetic oligonucleotide
  source 1..25: mol_type = other DNA
gatcacggcaaagttaaggagatca

SEQ ID NO: 1296 - DNA, 32 bp, synthetic construct
  misc_feature 1..32: note = synthetic oligonucleotide
  source 1..32: mol_type = other DNA
cgacagacgcctgatctccttaaagcggacat

SEQ ID NO: 1297 - DNA, 25 bp, synthetic construct
  misc_feature 1..25: note = synthetic oligonucleotide
  source 1..25: mol_type = other DNA
gatcatgtccgctttaaggagatca

SEQ ID NO: 1298 - DNA, 32 bp, synthetic construct
  misc_feature 1..32: note = synthetic oligonucleotide
  source 1..32: mol_type = other DNA
cgacagacgcctgatctcctgatttggacgat

SEQ ID NO: 1299 - DNA, 25 bp, synthetic construct
  misc_feature 1..25: note = synthetic oligonucleotide
  source 1..25: mol_type = other DNA
gatcatcgtccaaatcaggagatca

SEQ ID NO: 1300 - DNA, 32 bp, synthetic construct
  misc_feature 1..32: note = synthetic oligonucleotide
  source 1..32: mol_type = other DNA
cgacagacgcctgatctcctgaattgctcctt

SEQ ID NO: 1301 - DNA, 25 bp, synthetic construct
  misc_feature 1..25: note = synthetic oligonucleotide
  source 1..25: mol_type = other DNA
gatcaaggagcaattcaggagatca

SEQ ID NO: 1302 - DNA, 32 bp, synthetic construct
  misc_feature 1..32: note = synthetic oligonucleotide
  source 1..32: mol_type = other DNA
cgacagacgcctgatctcctgaagaatggcat

SEQ ID NO: 1303 - DNA, 25 bp, synthetic construct
  misc_feature 1..25: note = synthetic oligonucleotide
  source 1..25: mol_type = other DNA
gatcatgccattcttcaggagatca

SEQ ID NO: 1304 - DNA, 32 bp, synthetic construct
  misc_feature 1..32: note = synthetic oligonucleotide
  source 1..32: mol_type = other DNA
cgacagacgcctgatctcctctttgaagcctt

SEQ ID NO: 1305 - DNA, 25 bp, synthetic construct
  misc_feature 1..25: note = synthetic oligonucleotide
  source 1..25: mol_type = other DNA
gatcaaggcttcaaagaggagatca

SEQ ID NO: 1306 - DNA, 32 bp, synthetic construct
  misc_feature 1..32: note = synthetic oligonucleotide
  source 1..32: mol_type = other DNA
cgacagacgcctgatctcctcgcaaaggttat

SEQ ID NO: 1307 - DNA, 25 bp, synthetic construct
  misc_feature 1..25: note = synthetic oligonucleotide
  source 1..25: mol_type = other DNA
gatcataacctttgcgaggagatca

SEQ ID NO: 1308 - DNA, 32 bp, synthetic construct
  misc_feature 1..32: note = synthetic oligonucleotide
  source 1..32: mol_type = other DNA
cgacagacgcctgatctcctatggaagcgaat

SEQ ID NO: 1309 - DNA, 25 bp, synthetic construct
  misc_feature 1..25: note = synthetic oligonucleotide
  source 1..25: mol_type = other DNA
gatcattcgcttccataggagatca

SEQ ID NO: 1310 - DNA, 32 bp, synthetic construct
  misc_feature 1..32: note = synthetic oligonucleotide
  source 1..32: mol_type = other DNA
cgacagacgcctgatctcctatcaaagcggtt

SEQ ID NO: 1311 - DNA, 25 bp, synthetic construct
  misc_feature 1..25: note = synthetic oligonucleotide
  source 1..25: mol_type = other DNA
gatcaaccgctttgataggagatca

SEQ ID NO: 1312 - DNA, 32 bp, synthetic construct
  misc_feature 1..32: note = synthetic oligonucleotide
  source 1..32: mol_type = other DNA
cgacagacgcctgatctcctaattgtcgtgct

SEQ ID NO: 1313 - DNA, 25 bp, synthetic construct
  misc_feature 1..25: note = synthetic oligonucleotide
  source 1..25: mol_type = other DNA
gatcagcacgacaattaggagatca

SEQ ID NO: 1314 - DNA, 32 bp, synthetic construct
  misc_feature 1..32: note = synthetic oligonucleotide
  source 1..32: mol_type = other DNA
cgacagacgcctgatctcctaattcgtgcctt

SEQ ID NO: 1315 - DNA, 25 bp, synthetic construct
  misc_feature 1..25: note = synthetic oligonucleotide
  source 1..25: mol_type = other DNA
gatcaaggcacgaattaggagatca

SEQ ID NO: 1316 - DNA, 32 bp, synthetic construct
  misc_feature 1..32: note = synthetic oligonucleotide
  source 1..32: mol_type = other DNA
cgacagacgcctgatctcctaagattcgccat

SEQ ID NO: 1317 - DNA, 25 bp, synthetic construct
  misc_feature 1..25: note = synthetic oligonucleotide
  source 1..25: mol_type = other DNA
gatcatggcgaatcttaggagatca

SEQ ID NO: 1318 - DNA, 32 bp, synthetic construct
  misc_feature 1..32: note = synthetic oligonucleotide
  source 1..32: mol_type = other DNA
cgacagacgcctgatctcctaacgaaagcctt

SEQ ID NO: 1319 - DNA, 25 bp, synthetic construct
  misc_feature 1..25: note = synthetic oligonucleotide
  source 1..25: mol_type = other DNA
gatcaaggctttcgttaggagatca

SEQ ID NO: 1320 - DNA, 32 bp, synthetic construct
  misc_feature 1..32: note = synthetic oligonucleotide
  source 1..32: mol_type = other DNA
cgacagacgcctgatctccgtgtggaatttgt

SEQ ID NO: 1321 - DNA, 25 bp, synthetic construct
  misc_feature 1..25: note = synthetic oligonucleotide
  source 1..25: mol_type = other DNA
gatcacaaattccacacggagatca

SEQ ID NO: 1322 - DNA, 32 bp, synthetic construct
  misc_feature 1..32: note = synthetic oligonucleotide
  source 1..32: mol_type = other DNA
cgacagacgcctgatctccgtatttcagcctt

SEQ ID NO: 1323 - DNA, 25 bp, synthetic construct
  misc_feature 1..25: note = synthetic oligonucleotide
  source 1..25: mol_type = other DNA
gatcaaggctgaaatacggagatca

SEQ ID NO: 1324 - DNA, 32 bp, synthetic construct
  misc_feature 1..32: note = synthetic oligonucleotide
  source 1..32: mol_type = other DNA
cgacagacgcctgatctccggtaatgtgtgtt

SEQ ID NO: 1325 - DNA, 25 bp, synthetic construct
  misc_feature 1..25: note = synthetic oligonucleotide
  source 1..25: mol_type = other DNA
gatcaacacacattaccggagatca

SEQ ID NO: 1326 - DNA, 32 bp, synthetic construct
  misc_feature 1..32: note = synthetic oligonucleotide
  source 1..32: mol_type = other DNA
cgacagacgcctgatctccggcttaaacaact

SEQ ID NO: 1327 - DNA, 25 bp, synthetic construct
  misc_feature 1..25: note = synthetic oligonucleotide
  source 1..25: mol_type = other DNA
gatcagttgtttaagccggagatca

SEQ ID NO: 1328 - DNA, 32 bp, synthetic construct
  misc_feature 1..32: note = synthetic oligonucleotide
  source 1..32: mol_type = other DNA
cgacagacgcctgatctccggaggaattgaat

SEQ ID NO: 1329 - DNA, 25 bp, synthetic construct
  misc_feature 1..25: note = synthetic oligonucleotide
  source 1..25: mol_type = other DNA
gatcattcaattcctccggagatca

SEQ ID NO: 1330 - DNA, 32 bp, synthetic construct
  misc_feature 1..32: note = synthetic oligonucleotide
  source 1..32: mol_type = other DNA
cgacagacgcctgatctccggaatttggaact

SEQ ID NO: 1331 - DNA, 25 bp, synthetic construct
  misc_feature 1..25: note = synthetic oligonucleotide
  source 1..25: mol_type = other DNA
gatcagttccaaattccggagatca

SEQ ID NO: 1332 - DNA, 32 bp, synthetic construct
  misc_feature 1..32: note = synthetic oligonucleotide
  source 1..32: mol_type = other DNA
cgacagacgcctgatctccggaaattgatgct

SEQ ID NO: 1333 - DNA, 25 bp, synthetic construct
  misc_feature 1..25: note = synthetic oligonucleotide
  source 1..25: mol_type = other DNA
gatcagcatcaatttccggagatca

SEQ ID NO: 1334 - DNA, 32 bp, synthetic construct
  misc_feature 1..32: note = synthetic oligonucleotide
  source 1..32: mol_type = other DNA
cgacagacgcctgatctccgcggaattaaagt

SEQ ID NO: 1335 - DNA, 25 bp, synthetic construct
  misc_feature 1..25: note = synthetic oligonucleotide
  source 1..25: mol_type = other DNA
gatcactttaattccgcggagatca

SEQ ID NO: 1336 - DNA, 32 bp, synthetic construct
  misc_feature 1..32: note = synthetic oligonucleotide
  source 1..32: mol_type = other DNA
cgacagacgcctgatctccgatttgtgatgct

SEQ ID NO: 1337 - DNA, 25 bp, synthetic construct
  misc_feature 1..25: note = synthetic oligonucleotide
  source 1..25: mol_type = other DNA
gatcagcatcacaaatcggagatca

SEQ ID NO: 1338 - DNA, 32 bp, synthetic construct
  misc_feature 1..32: note = synthetic oligonucleotide
  source 1..32: mol_type = other DNA
cgacagacgcctgatctccgatttaccgtctt

SEQ ID NO: 1339 - DNA, 25 bp, synthetic construct
  misc_feature 1..25: note = synthetic oligonucleotide
  source 1..25: mol_type = other DNA
gatcaagacggtaaatcggagatca

SEQ ID NO: 1340 - DNA, 32 bp, synthetic construct
  misc_feature 1..32: note = synthetic oligonucleotide
  source 1..32: mol_type = other DNA
cgacagacgcctgatctccgattgtgtaggtt

SEQ ID NO: 1341 - DNA, 25 bp, synthetic construct
  misc_feature 1..25: note = synthetic oligonucleotide
  source 1..25: mol_type = other DNA
gatcaacctacacaatcggagatca

SEQ ID NO: 1342 - DNA, 32 bp, synthetic construct
  misc_feature 1..32: note = synthetic oligonucleotide
  source 1..32: mol_type = other DNA
cgacagacgcctgatctccatttcacggtctt

SEQ ID NO: 1343 - DNA, 25 bp, synthetic construct
  misc_feature 1..25: note = synthetic oligonucleotide
  source 1..25: mol_type = other DNA
gatcaagaccgtgaaatggagatca

SEQ ID NO: 1344 - DNA, 32 bp, synthetic construct
  misc_feature 1..32: note = synthetic oligonucleotide
  source 1..32: mol_type = other DNA
cgacagacgcctgatctccatttaggcaggtt

SEQ ID NO: 1345 - DNA, 25 bp, synthetic construct
  misc_feature 1..25: note = synthetic oligonucleotide
  source 1..25: mol_type = other DNA
gatcaacctgcctaaatggagatca

SEQ ID NO: 1346 - DNA, 32 bp, synthetic construct
  misc_feature 1..32: note = synthetic oligonucleotide
  source 1..32: mol_type = other DNA
cgacagacgcctgatctccattgttagcgtct

SEQ ID NO: 1347 - DNA, 25 bp, synthetic construct
  misc_feature 1..25: note = synthetic oligonucleotide
  source 1..25: mol_type = other DNA
gatcagacgctaacaatggagatca

SEQ ID NO: 1348 - DNA, 32 bp, synthetic construct
  misc_feature 1..32: note = synthetic oligonucleotide
  source 1..32: mol_type = other DNA
cgacagacgcctgatctccattgaacgaacct

SEQ ID NO: 1349 - DNA, 25 bp, synthetic construct
  misc_feature 1..25: note = synthetic oligonucleotide
  source 1..25: mol_type = other DNA
gatcaggttcgttcaatggagatca

SEQ ID NO: 1350 - DNA, 32 bp, synthetic construct
  misc_feature 1..32: note = synthetic oligonucleotide
  source 1..32: mol_type = other DNA
cgacagacgcctgatctccattaggcgagaat

SEQ ID NO: 1351 - DNA, 25 bp, synthetic construct
  misc_feature 1..25: note = synthetic oligonucleotide
  source 1..25: mol_type = other DNA
gatcattctcgcctaatggagatca

SEQ ID NO: 1352 - DNA, 32 bp, synthetic construct
  misc_feature 1..32: note = synthetic oligonucleotide
  source 1..32: mol_type = other DNA
cgacagacgcctgatctccatgatgtgaacgt

SEQ ID NO: 1353 - DNA, 25 bp, synthetic construct
  misc_feature 1..25: note = synthetic oligonucleotide
  source 1..25: mol_type = other DNA
gatcacgttcacatcatggagatca

SEQ ID NO: 1354 - DNA, 32 bp, synthetic construct
  misc_feature 1..32: note = synthetic oligonucleotide
  source 1..32: mol_type = other DNA
cgacagacgcctgatctccatagaatccgcat

SEQ ID NO: 1355 - DNA, 25 bp, synthetic construct
  misc_feature 1..25: note = synthetic oligonucleotide
  source 1..25: mol_type = other DNA
gatcatgcggattctatggagatca

SEQ ID NO: 1356 - DNA, 32 bp, synthetic construct
  misc_feature 1..32: note = synthetic oligonucleotide
  source 1..32: mol_type = other DNA
cgacagacgcctgatctccatacttgtcgctt

SEQ ID NO: 1357 - DNA, 25 bp, synthetic construct
  misc_feature 1..25: note = synthetic oligonucleotide
  source 1..25: mol_type = other DNA
gatcaagcgacaagtatggagatca

SEQ ID NO: 1358 - DNA, 32 bp, synthetic construct
  misc_feature 1..32: note = synthetic oligonucleotide
  source 1..32: mol_type = other DNA
cgacagacgcctgatctccataacgtgtccat

SEQ ID NO: 1359 - DNA, 25 bp, synthetic construct
  misc_feature 1..25: note = synthetic oligonucleotide
  source 1..25: mol_type = other DNA
gatcatggacacgttatggagatca

SEQ ID NO: 1360 - DNA, 32 bp, synthetic construct
  misc_feature 1..32: note = synthetic oligonucleotide
  source 1..32: mol_type = other DNA
cgacagacgcctgatctccagttgttcctcat

SEQ ID NO: 1361 - DNA, 25 bp, synthetic construct
  misc_feature 1..25: note = synthetic oligonucleotide
  source 1..25: mol_type = other DNA
gatcatgaggaacaactggagatca

SEQ ID NO: 1362 - DNA, 32 bp, synthetic construct
  misc_feature 1..32: note = synthetic oligonucleotide
  source 1..32: mol_type = other DNA
cgacagacgcctgatctccagttatgttcgct

SEQ ID NO: 1363 - DNA, 25 bp, synthetic construct
  misc_feature 1..25: note = synthetic oligonucleotide
  source 1..25: mol_type = other DNA
gatcagcgaacataactggagatca

SEQ ID NO: 1364 - DNA, 32 bp, synthetic construct
  misc_feature 1..32: note = synthetic oligonucleotide
  source 1..32: mol_type = other DNA
cgacagacgcctgatctccagtgttgagtgtt

SEQ ID NO: 1365 - DNA, 25 bp, synthetic construct
  misc_feature 1..25: note = synthetic oligonucleotide
  source 1..25: mol_type = other DNA
gatcaacactcaacactggagatca

SEQ ID NO: 1366 - DNA, 32 bp, synthetic construct
  misc_feature 1..32: note = synthetic oligonucleotide
  source 1..32: mol_type = other DNA
cgacagacgcctgatctccaggtgaaagtgat

SEQ ID NO: 1367 - DNA, 25 bp, synthetic construct
  misc_feature 1..25: note = synthetic oligonucleotide
  source 1..25: mol_type = other DNA
gatcatcactttcacctggagatca

SEQ ID NO: 1368 - DNA, 32 bp, synthetic construct
  misc_feature 1..32: note = synthetic oligonucleotide
  source 1..32: mol_type = other DNA
cgacagacgcctgatctccagaaggttgtcat

SEQ ID NO: 1369 - DNA, 25 bp, synthetic construct
  misc_feature 1..25: note = synthetic oligonucleotide
  source 1..25: mol_type = other DNA
gatcatgacaaccttctggagatca

SEQ ID NO: 1370 - DNA, 32 bp, synthetic construct
  misc_feature 1..32: note = synthetic oligonucleotide
  source 1..32: mol_type = other DNA
cgacagacgcctgatctccactggtggaaatt

SEQ ID NO: 1371 - DNA, 25 bp, synthetic construct
  misc_feature 1..25: note = synthetic oligonucleotide
  source 1..25: mol_type = other DNA
gatcaatttccaccagtggagatca

SEQ ID NO: 1372 - DNA, 32 bp, synthetic construct
  misc_feature 1..32: note = synthetic oligonucleotide
  source 1..32: mol_type = other DNA
cgacagacgcctgatctccacgttgagaagat

SEQ ID NO: 1373 - DNA, 25 bp, synthetic construct
  misc_feature 1..25: note = synthetic oligonucleotide
  source 1..25: mol_type = other DNA
gatcatcttctcaacgtggagatca

SEQ ID NO: 1374 - DNA, 32 bp, synthetic construct
  misc_feature 1..32: note = synthetic oligonucleotide
  source 1..32: mol_type = other DNA
cgacagacgcctgatctccacattagcgttct

SEQ ID NO: 1375 - DNA, 25 bp, synthetic construct
  misc_feature 1..25: note = synthetic oligonucleotide
  source 1..25: mol_type = other DNA
gatcagaacgctaatgtggagatca

SEQ ID NO: 1376 - DNA, 32 bp, synthetic construct
  misc_feature 1..32: note = synthetic oligonucleotide
  source 1..32: mol_type = other DNA
cgacagacgcctgatctccacaagttccgatt

SEQ ID NO: 1377 - DNA, 25 bp, synthetic construct
  misc_feature 1..25: note = synthetic oligonucleotide
  source 1..25: mol_type = other DNA
gatcaatcggaacttgtggagatca

SEQ ID NO: 1378 - DNA, 32 bp, synthetic construct
  misc_feature 1..32: note = synthetic oligonucleotide
  source 1..32: mol_type = other DNA
cgacagacgcctgatctccaatttagccacgt

SEQ ID NO: 1379 - DNA, 25 bp, synthetic construct
  misc_feature 1..25: note = synthetic oligonucleotide
  source 1..25: mol_type = other DNA
gatcacgtggctaaattggagatca

SEQ ID NO: 1380 - DNA, 32 bp, synthetic construct
  misc_feature 1..32: note = synthetic oligonucleotide
  source 1..32: mol_type = other DNA
cgacagacgcctgatctccaattgcgtcttct

SEQ ID NO: 1381 - DNA, 25 bp, synthetic construct
  misc_feature 1..25: note = synthetic oligonucleotide
  source 1..25: mol_type = other DNA
gatcagaagacgcaattggagatca

SEQ ID NO: 1382 - DNA, 32 bp, synthetic construct
  misc_feature 1..32: note = synthetic oligonucleotide
  source 1..32: mol_type = other DNA
cgacagacgcctgatctccaattacagacgct

SEQ ID NO: 1383 - DNA, 25 bp, synthetic construct
  misc_feature 1..25: note = synthetic oligonucleotide
  source 1..25: mol_type = other DNA
gatcagcgtctgtaattggagatca

SEQ ID NO: 1384 - DNA, 32 bp, synthetic construct
  misc_feature 1..32: note = synthetic oligonucleotide
  source 1..32: mol_type = other DNA
cgacagacgcctgatctccaaggtttggtgat

SEQ ID NO: 1385 - DNA, 25 bp, synthetic construct
  misc_feature 1..25: note = synthetic oligonucleotide
  source 1..25: mol_type = other DNA
gatcatcaccaaaccttggagatca

SEQ ID NO: 1386 - DNA, 32 bp, synthetic construct
  misc_feature 1..32: note = synthetic oligonucleotide
  source 1..32: mol_type = other DNA
cgacagacgcctgatctccaagagtggtcaat

SEQ ID NO: 1387 - DNA, 25 bp, synthetic construct
  misc_feature 1..25: note = synthetic oligonucleotide
  source 1..25: mol_type = other DNA
gatcattgaccactcttggagatca

SEQ ID NO: 1388 - DNA, 32 bp, synthetic construct
  misc_feature 1..32: note = synthetic oligonucleotide
  source 1..32: mol_type = other DNA
cgacagacgcctgatctccaagaatacggctt

SEQ ID NO: 1389 - DNA, 25 bp, synthetic construct
  misc_feature 1..25: note = synthetic oligonucleotide
  source 1..25: mol_type = other DNA
gatcaagccgtattcttggagatca

SEQ ID NO: 1390 - DNA, 32 bp, synthetic construct
  misc_feature 1..32: note = synthetic oligonucleotide
  source 1..32: mol_type = other DNA
cgacagacgcctgatctccaacactggaactt

SEQ ID NO: 1391 - DNA, 25 bp, synthetic construct
  misc_feature 1..25: note = synthetic oligonucleotide
  source 1..25: mol_type = other DNA
gatcaagttccagtgttggagatca

SEQ ID NO: 1392 - DNA, 32 bp, synthetic construct
  misc_feature 1..32: note = synthetic oligonucleotide
  source 1..32: mol_type = other DNA
cgacagacgcctgatctccaaactgctgaact

SEQ ID NO: 1393 - DNA, 25 bp, synthetic construct
  misc_feature 1..25: note = synthetic oligonucleotide
  source 1..25: mol_type = other DNA
gatcagttcagcagtttggagatca

SEQ ID NO: 1394 - DNA, 32 bp, synthetic construct
  misc_feature 1..32: note = synthetic oligonucleotide
  source 1..32: mol_type = other DNA
cgacagacgcctgatctccaaacattagccgt

SEQ ID NO: 1395 - DNA, 25 bp, synthetic construct
  misc_feature 1..25: note = synthetic oligonucleotide
  source 1..25: mol_type = other DNA
gatcacggctaatgtttggagatca

SEQ ID NO: 1396 - DNA, 32 bp, synthetic construct
  misc_feature 1..32: note = synthetic oligonucleotide
  source 1..32: mol_type = other DNA
cgacagacgcctgatctcatttgtgcggtagt

SEQ ID NO: 1397 - DNA, 25 bp, synthetic construct
  misc_feature 1..25: note = synthetic oligonucleotide
  source 1..25: mol_type = other DNA
gatcactaccgcacaaatgagatca

SEQ ID NO: 1398 - DNA, 32 bp, synthetic construct
  misc_feature 1..32: note = synthetic oligonucleotide
  source 1..32: mol_type = other DNA
cgacagacgcctgatctcatttgcgaccttct

SEQ ID NO: 1399 - DNA, 25 bp, synthetic construct
  misc_feature 1..25: note = synthetic oligonucleotide
  source 1..25: mol_type = other DNA
gatcagaaggtcgcaaatgagatca

SEQ ID NO: 1400 - DNA, 32 bp, synthetic construct
  misc_feature 1..32: note = synthetic oligonucleotide
  source 1..32: mol_type = other DNA
cgacagacgcctgatctcatttgatcgtggct

SEQ ID NO: 1401 - DNA, 25 bp, synthetic construct
  misc_feature 1..25: note = synthetic oligonucleotide
  source 1..25: mol_type = other DNA
gatcagccacgatcaaatgagatca

SEQ ID NO: 1402 - DNA, 32 bp, synthetic construct
  misc_feature 1..32: note = synthetic oligonucleotide
  source 1..32: mol_type = other DNA
cgacagacgcctgatctcatttcatgcggtct

SEQ ID NO: 1403 - DNA, 25 bp, synthetic construct
  misc_feature 1..25: note = synthetic oligonucleotide
  source 1..25: mol_type = other DNA
gatcagaccgcatgaaatgagatca

SEQ ID NO: 1404 - DNA, 32 bp, synthetic construct
  misc_feature 1..32: note = synthetic oligonucleotide
  source 1..32: mol_type = other DNA
cgacagacgcctgatctcatttactggtgcgt

SEQ ID NO: 1405 - DNA, 25 bp, synthetic construct
  misc_feature 1..25: note = synthetic oligonucleotide
  source 1..25: mol_type = other DNA
gatcacgcaccagtaaatgagatca

SEQ ID NO: 1406 - DNA, 32 bp, synthetic construct
  misc_feature 1..32: note = synthetic oligonucleotide
  source 1..32: mol_type = other DNA
cgacagacgcctgatctcattgttctaccgct

SEQ ID NO: 1407 - DNA, 25 bp, synthetic construct
  misc_feature 1..25: note = synthetic oligonucleotide
  source 1..25: mol_type = other DNA
gatcagcggtagaacaatgagatca

SEQ ID NO: 1408 - DNA, 32 bp, synthetic construct
  misc_feature 1..32: note = synthetic oligonucleotide
  source 1..32: mol_type = other DNA
cgacagacgcctgatctcattgtggatgctgt

SEQ ID NO: 1409 - DNA, 25 bp, synthetic construct
  misc_feature 1..25: note = synthetic oligonucleotide
  source 1..25: mol_type = other DNA
gatcacagcatccacaatgagatca

SEQ ID NO: 1410 - DNA, 32 bp, synthetic construct
  misc_feature 1..32: note = synthetic oligonucleotide
  source 1..32: mol_type = other DNA
cgacagacgcctgatctcattggaacggactt

SEQ ID NO: 1411 - DNA, 25 bp, synthetic construct
  misc_feature 1..25: note = synthetic oligonucleotide
  source 1..25: mol_type = other DNA
gatcaagtccgttccaatgagatca

SEQ ID NO: 1412 - DNA, 32 bp, synthetic construct
  misc_feature 1..32: note = synthetic oligonucleotide
  source 1..32: mol_type = other DNA
cgacagacgcctgatctcattgaactctcgct

SEQ ID NO: 1413 - DNA, 25 bp, synthetic construct
  misc_feature 1..25: note = synthetic oligonucleotide
  source 1..25: mol_type = other DNA
gatcagcgagagttcaatgagatca

SEQ ID NO: 1414 - DNA, 32 bp, synthetic construct
  misc_feature 1..32: note = synthetic oligonucleotide
  source 1..32: mol_type = other DNA
cgacagacgcctgatctcattctaaggcggtt

SEQ ID NO: 1415 - DNA, 25 bp, synthetic construct
  misc_feature 1..25: note = synthetic oligonucleotide
  source 1..25: mol_type = other DNA
gatcaaccgccttagaatgagatca

SEQ ID NO: 1416 - DNA, 32 bp, synthetic construct
  misc_feature 1..32: note = synthetic oligonucleotide
  source 1..32: mol_type = other DNA
cgacagacgcctgatctcattcgtagttggct

SEQ ID NO: 1417 - DNA, 25 bp, synthetic construct
  misc_feature 1..25: note = synthetic oligonucleotide
  source 1..25: mol_type = other DNA
gatcagccaactacgaatgagatca

SEQ ID NO: 1418 - DNA, 32 bp, synthetic construct
  misc_feature 1..32: note = synthetic oligonucleotide
  source 1..32: mol_type = other DNA
cgacagacgcctgatctcattccaatgtcgct

SEQ ID NO: 1419 - DNA, 25 bp, synthetic construct
  misc_feature 1..25: note = synthetic oligonucleotide
  source 1..25: mol_type = other DNA
gatcagcgacattggaatgagatca

SEQ ID NO: 1420 - DNA, 32 bp, synthetic construct
  misc_feature 1..32: note = synthetic oligonucleotide
  source 1..32: mol_type = other DNA
cgacagacgcctgatctcattatgtcacgcct

SEQ ID NO: 1421 - DNA, 25 bp, synthetic construct
  misc_feature 1..25: note = synthetic oligonucleotide
  source 1..25: mol_type = other DNA
gatcaggcgtgacataatgagatca

SEQ ID NO: 1422 - DNA, 32 bp, synthetic construct
  misc_feature 1..32: note = synthetic oligonucleotide
  source 1..32: mol_type = other DNA
cgacagacgcctgatctcattatggtgcgtct

SEQ ID NO: 1423 - DNA, 25 bp, synthetic construct
  misc_feature 1..25: note = synthetic oligonucleotide
  source 1..25: mol_type = other DNA
gatcagacgcaccataatgagatca

SEQ ID NO: 1424 - DNA, 32 bp, synthetic construct
  misc_feature 1..32: note = synthetic oligonucleotide
  source 1..32: mol_type = other DNA
cgacagacgcctgatctcattaaccgtccgat

SEQ ID NO: 1425 - DNA, 25 bp, synthetic construct
  misc_feature 1..25: note = synthetic oligonucleotide
  source 1..25: mol_type = other DNA
gatcatcggacggttaatgagatca

SEQ ID NO: 1426 - DNA, 32 bp, synthetic construct
  misc_feature 1..32: note = synthetic oligonucleotide
  source 1..32: mol_type = other DNA
cgacagacgcctgatctcatggtgattgtcgt

SEQ ID NO: 1427 - DNA, 25 bp, synthetic construct
  misc_feature 1..25: note = synthetic oligonucleotide
  source 1..25: mol_type = other DNA
gatcacgacaatcaccatgagatca

SEQ ID NO: 1428 - DNA, 32 bp, synthetic construct
  misc_feature 1..32: note = synthetic oligonucleotide
  source 1..32: mol_type = other DNA
cgacagacgcctgatctcatggccaaacttct

SEQ ID NO: 1429 - DNA, 25 bp, synthetic construct
  misc_feature 1..25: note = synthetic oligonucleotide
  source 1..25: mol_type = other DNA
gatcagaagtttggccatgagatca

SEQ ID NO: 1430 - DNA, 32 bp, synthetic construct
  misc_feature 1..32: note = synthetic oligonucleotide
  source 1..32: mol_type = other DNA
cgacagacgcctgatctcatgacaggtggttt

SEQ ID NO: 1431 - DNA, 25 bp, synthetic construct
  misc_feature 1..25: note = synthetic oligonucleotide
  source 1..25: mol_type = other DNA
gatcaaaccacctgtcatgagatca

SEQ ID NO: 1432 - DNA, 32 bp, synthetic construct
  misc_feature 1..32: note = synthetic oligonucleotide
  source 1..32: mol_type = other DNA
cgacagacgcctgatctcatctcaagtccgtt

SEQ ID NO: 1433 - DNA, 25 bp, synthetic construct
  misc_feature 1..25: note = synthetic oligonucleotide
  source 1..25: mol_type = other DNA
gatcaacggacttgagatgagatca

SEQ ID NO: 1434 - DNA, 32 bp, synthetic construct
  misc_feature 1..32: note = synthetic oligonucleotide
  source 1..32: mol_type = other DNA
cgacagacgcctgatctcatcgagaaatggct

SEQ ID NO: 1435 - DNA, 25 bp, synthetic construct
  misc_feature 1..25: note = synthetic oligonucleotide
  source 1..25: mol_type = other DNA
gatcagccatttctcgatgagatca

SEQ ID NO: 1436 - DNA, 32 bp, synthetic construct
  misc_feature 1..32: note = synthetic oligonucleotide
  source 1..32: mol_type = other DNA
cgacagacgcctgatctcatcgaagacacctt

SEQ ID NO: 1437 - DNA, 25 bp, synthetic construct
  misc_feature 1..25: note = synthetic oligonucleotide
  source 1..25: mol_type = other DNA
gatcaaggtgtcttcgatgagatca

SEQ ID NO: 1438 - DNA, 32 bp, synthetic construct
  misc_feature 1..32: note = synthetic oligonucleotide
  source 1..32: mol_type = other DNA
cgacagacgcctgatctcatagttaccgccat

SEQ ID NO: 1439 - DNA, 25 bp, synthetic construct
  misc_feature 1..25: note = synthetic oligonucleotide
  source 1..25: mol_type = other DNA
gatcatggcggtaactatgagatca

SEQ ID NO: 1440 - DNA, 32 bp, synthetic construct
  misc_feature 1..32: note = synthetic oligonucleotide
  source 1..32: mol_type = other DNA
cgacagacgcctgatctcatagtcgtttggct

SEQ ID NO: 1441 - DNA, 25 bp, synthetic construct
  misc_feature 1..25: note = synthetic oligonucleotide
  source 1..25: mol_type = other DNA
gatcagccaaacgactatgagatca

SEQ ID NO: 1442 - DNA, 32 bp, synthetic construct
  misc_feature 1..32: note = synthetic oligonucleotide
  source 1..32: mol_type = other DNA
cgacagacgcctgatctcatacttgagcggat

SEQ ID NO: 1443 - DNA, 25 bp, synthetic construct
  misc_feature 1..25: note = synthetic oligonucleotide
  source 1..25: mol_type = other DNA
gatcatccgctcaagtatgagatca

SEQ ID NO: 1444 - DNA, 32 bp, synthetic construct
  misc_feature 1..32: note = synthetic oligonucleotide
  source 1..32: mol_type = other DNA
cgacagacgcctgatctcataattcgcgtggt

SEQ ID NO: 1445 - DNA, 25 bp, synthetic construct
  misc_feature 1..25: note = synthetic oligonucleotide
  source 1..25: mol_type = other DNA
gatcaccacgcgaattatgagatca

SEQ ID NO: 1446 - DNA, 32 bp, synthetic construct
  misc_feature 1..32: note = synthetic oligonucleotide
  source 1..32: mol_type = other DNA
cgacagacgcctgatctcagttgtagttgcgt

SEQ ID NO: 1447 - DNA, 25 bp, synthetic construct
  misc_feature 1..25: note = synthetic oligonucleotide
  source 1..25: mol_type = other DNA
gatcacgcaactacaactgagatca

SEQ ID NO: 1448 - DNA, 32 bp, synthetic construct
  misc_feature 1..32: note = synthetic oligonucleotide
  source 1..32: mol_type = other DNA
cgacagacgcctgatctcaggttcacttccat

SEQ ID NO: 1449 - DNA, 25 bp, synthetic construct
  misc_feature 1..25: note = synthetic oligonucleotide
  source 1..25: mol_type = other DNA
gatcatggaagtgaacctgagatca

SEQ ID NO: 1450 - DNA, 32 bp, synthetic construct
  misc_feature 1..32: note = synthetic oligonucleotide
  source 1..32: mol_type = other DNA
cgacagacgcctgatctcaggcgaggtttatt

SEQ ID NO: 1451 - DNA, 25 bp, synthetic construct
  misc_feature 1..25: note = synthetic oligonucleotide
  source 1..25: mol_type = other DNA
gatcaataaacctcgcctgagatca

SEQ ID NO: 1452 - DNA, 32 bp, synthetic construct
  misc_feature 1..32: note = synthetic oligonucleotide
  source 1..32: mol_type = other DNA
cgacagacgcctgatctcaggaataagcggtt

SEQ ID NO: 1453 - DNA, 25 bp, synthetic construct
  misc_feature 1..25: note = synthetic oligonucleotide
  source 1..25: mol_type = other DNA
gatcaaccgcttattcctgagatca

SEQ ID NO: 1454 - DNA, 32 bp, synthetic construct
  misc_feature 1..32: note = synthetic oligonucleotide
  source 1..32: mol_type = other DNA
cgacagacgcctgatctcagattctttccgct

SEQ ID NO: 1455 - DNA, 25 bp, synthetic construct
  misc_feature 1..25: note = synthetic oligonucleotide
  source 1..25: mol_type = other DNA
gatcagcggaaagaatctgagatca

SEQ ID NO: 1456 - DNA, 32 bp, synthetic construct
  misc_feature 1..32: note = synthetic oligonucleotide
  source 1..32: mol_type = other DNA
cgacagacgcctgatctcagatcctttgccat

SEQ ID NO: 1457 - DNA, 25 bp, synthetic construct
  misc_feature 1..25: note = synthetic oligonucleotide
  source 1..25: mol_type = other DNA
gatcatggcaaaggatctgagatca

SEQ ID NO: 1458 - DNA, 32 bp, synthetic construct
  misc_feature 1..32: note = synthetic oligonucleotide
  source 1..32: mol_type = other DNA
cgacagacgcctgatctcactttccgttgact

SEQ ID NO: 1459 - DNA, 25 bp, synthetic construct
  misc_feature 1..25: note = synthetic oligonucleotide
  source 1..25: mol_type = other DNA
gatcagtcaacggaaagtgagatca

SEQ ID NO: 1460 - DNA, 32 bp, synthetic construct
  misc_feature 1..32: note = synthetic oligonucleotide
  source 1..32: mol_type = other DNA
cgacagacgcctgatctcactttaagcaccgt

SEQ ID NO: 1461 - DNA, 25 bp, synthetic construct
  misc_feature 1..25: note = synthetic oligonucleotide
  source 1..25: mol_type = other DNA
gatcacggtgcttaaagtgagatca

SEQ ID NO: 1462 - DNA, 32 bp, synthetic construct
  misc_feature 1..32: note = synthetic oligonucleotide
  source 1..32: mol_type = other DNA
cgacagacgcctgatctcactgttattcgcct

SEQ ID NO: 1463 - DNA, 25 bp, synthetic construct
  misc_feature 1..25: note = synthetic oligonucleotide
  source 1..25: mol_type = other DNA
gatcaggcgaataacagtgagatca

SEQ ID NO: 1464 - DNA, 32 bp, synthetic construct
  misc_feature 1..32: note = synthetic oligonucleotide
  source 1..32: mol_type = other DNA
cgacagacgcctgatctcactcttgtaacgct

SEQ ID NO: 1465 - DNA, 25 bp, synthetic construct
  misc_feature 1..25: note = synthetic oligonucleotide
  source 1..25: mol_type = other DNA
gatcagcgttacaagagtgagatca

SEQ ID NO: 1466 - DNA, 32 bp, synthetic construct
  misc_feature 1..32: note = synthetic oligonucleotide
  source 1..32: mol_type = other DNA
cgacagacgcctgatctcactccaaggtcaat

SEQ ID NO: 1467 - DNA, 25 bp, synthetic construct
  misc_feature 1..25: note = synthetic oligonucleotide
  source 1..25: mol_type = other DNA
gatcattgaccttggagtgagatca

SEQ ID NO: 1468 - DNA, 32 bp, synthetic construct
  misc_feature 1..32: note = synthetic oligonucleotide
  source 1..32: mol_type = other DNA
cgacagacgcctgatctcactagtttgcgtct

SEQ ID NO: 1469 - DNA, 25 bp, synthetic construct
  misc_feature 1..25: note = synthetic oligonucleotide
  source 1..25: mol_type = other DNA
gatcagacgcaaactagtgagatca

SEQ ID NO: 1470 - DNA, 32 bp, synthetic construct
  misc_feature 1..32: note = synthetic oligonucleotide
  source 1..32: mol_type = other DNA
cgacagacgcctgatctcactaatgaacggct

SEQ ID NO: 1471 - DNA, 25 bp, synthetic construct
  misc_feature 1..25: note = synthetic oligonucleotide
  source 1..25: mol_type = other DNA
gatcagccgttcattagtgagatca

SEQ ID NO: 1472 - DNA, 32 bp, synthetic construct
  misc_feature 1..32: note = synthetic oligonucleotide
  source 1..32: mol_type = other DNA
cgacagacgcctgatctcacgttatcttggct

SEQ ID NO: 1473 - DNA, 25 bp, synthetic construct
  misc_feature 1..25: note = synthetic oligonucleotide
  source 1..25: mol_type = other DNA
gatcagccaagataacgtgagatca

SEQ ID NO: 1474 - DNA, 32 bp, synthetic construct
  misc_feature 1..32: note = synthetic oligonucleotide
  source 1..32: mol_type = other DNA
cgacagacgcctgatctcacggagatggtttt

SEQ ID NO: 1475 - DNA, 25 bp, synthetic construct
  misc_feature 1..25: note = synthetic oligonucleotide
  source 1..25: mol_type = other DNA
gatcaaaaccatctccgtgagatca

SEQ ID NO: 1476 - DNA, 32 bp, synthetic construct
  misc_feature 1..32: note = synthetic oligonucleotide
  source 1..32: mol_type = other DNA
cgacagacgcctgatctcacggaagagatgtt

SEQ ID NO: 1477 - DNA, 25 bp, synthetic construct
  misc_feature 1..25: note = synthetic oligonucleotide
  source 1..25: mol_type = other DNA
gatcaacatctcttccgtgagatca

SEQ ID NO: 1478 - DNA, 32 bp, synthetic construct
  misc_feature 1..32: note = synthetic oligonucleotide
  source 1..32: mol_type = other DNA
cgacagacgcctgatctcacgatttagcacct

SEQ ID NO: 1479 - DNA, 25 bp, synthetic construct
  misc_feature 1..25: note = synthetic oligonucleotide
  source 1..25: mol_type = other DNA
gatcaggtgctaaatcgtgagatca

SEQ ID NO: 1480 - DNA, 32 bp, synthetic construct
  misc_feature 1..32: note = synthetic oligonucleotide
  source 1..32: mol_type = other DNA
cgacagacgcctgatctcacgatagtttgcct

SEQ ID NO: 1481 - DNA, 25 bp, synthetic construct
  misc_feature 1..25: note = synthetic oligonucleotide
  source 1..25: mol_type = other DNA
gatcaggcaaactatcgtgagatca

SEQ ID NO: 1482 - DNA, 32 bp, synthetic construct
  misc_feature 1..32: note = synthetic oligonucleotide
  source 1..32: mol_type = other DNA
cgacagacgcctgatctcaccttattgcacgt

SEQ ID NO: 1483 - DNA, 25 bp, synthetic construct
  misc_feature 1..25: note = synthetic oligonucleotide
  source 1..25: mol_type = other DNA
gatcacgtgcaataaggtgagatca

SEQ ID NO: 1484 - DNA, 32 bp, synthetic construct
  misc_feature 1..32: note = synthetic oligonucleotide
  source 1..32: mol_type = other DNA
cgacagacgcctgatctcacctccggttaaat

SEQ ID NO: 1485 - DNA, 25 bp, synthetic construct
  misc_feature 1..25: note = synthetic oligonucleotide
  source 1..25: mol_type = other DNA
gatcatttaaccggaggtgagatca

SEQ ID NO: 1486 - DNA, 32 bp, synthetic construct
  misc_feature 1..32: note = synthetic oligonucleotide
  source 1..32: mol_type = other DNA
cgacagacgcctgatctcacctatgcgaaact

SEQ ID NO: 1487 - DNA, 25 bp, synthetic construct
  misc_feature 1..25: note = synthetic oligonucleotide
  source 1..25: mol_type = other DNA
gatcagtttcgcataggtgagatca

SEQ ID NO: 1488 - DNA, 32 bp, synthetic construct
  misc_feature 1..32: note = synthetic oligonucleotide
  source 1..32: mol_type = other DNA
cgacagacgcctgatctcacattggcagaact

SEQ ID NO: 1489 - DNA, 25 bp, synthetic construct
  misc_feature 1..25: note = synthetic oligonucleotide
  source 1..25: mol_type = other DNA
gatcagttctgccaatgtgagatca

SEQ ID NO: 1490 - DNA, 32 bp, synthetic construct
  misc_feature 1..32: note = synthetic oligonucleotide
  source 1..32: mol_type = other DNA
cgacagacgcctgatctcacataggagcgttt

SEQ ID NO: 1491 - DNA, 25 bp, synthetic construct
  misc_feature 1..25: note = synthetic oligonucleotide
  source 1..25: mol_type = other DNA
gatcaaacgctcctatgtgagatca

SEQ ID NO: 1492 - DNA, 32 bp, synthetic construct
  misc_feature 1..32: note = synthetic oligonucleotide
  source 1..32: mol_type = other DNA
cgacagacgcctgatctcacaatgttgcctct

SEQ ID NO: 1493 - DNA, 25 bp, synthetic construct
  misc_feature 1..25: note = synthetic oligonucleotide
  source 1..25: mol_type = other DNA
gatcagaggcaacattgtgagatca

SEQ ID NO: 1494 - DNA, 32 bp, synthetic construct
  misc_feature 1..32: note = synthetic oligonucleotide
  source 1..32: mol_type = other DNA
cgacagacgcctgatctcacaatatgtccgct

SEQ ID NO: 1495 - DNA, 25 bp, synthetic construct
  misc_feature 1..25: note = synthetic oligonucleotide
  source 1..25: mol_type = other DNA
gatcagcggacatattgtgagatca

SEQ ID NO: 1496 - DNA, 32 bp, synthetic construct
  misc_feature 1..32: note = synthetic oligonucleotide
  source 1..32: mol_type = other DNA
cgacagacgcctgatctcaattcgagcaacct

SEQ ID NO: 1497 - DNA, 25 bp, synthetic construct
  misc_feature 1..25: note = synthetic oligonucleotide
  source 1..25: mol_type = other DNA
gatcaggttgctcgaattgagatca

SEQ ID NO: 1498 - DNA, 32 bp, synthetic construct
  misc_feature 1..32: note = synthetic oligonucleotide
  source 1..32: mol_type = other DNA
cgacagacgcctgatctcaatgttgctgaggt

SEQ ID NO: 1499 - DNA, 25 bp, synthetic construct
  misc_feature 1..25: note = synthetic oligonucleotide
  source 1..25: mol_type = other DNA
gatcacctcagcaacattgagatca

SEQ ID NO: 1500 - DNA, 32 bp, synthetic construct
  misc_feature 1..32: note = synthetic oligonucleotide
  source 1..32: mol_type = other DNA
cgacagacgcctgatctcaatggatgacggat

SEQ ID NO: 1501 - DNA, 25 bp, synthetic construct
  misc_feature 1..25: note = synthetic oligonucleotide
  source 1..25: mol_type = other DNA
gatcatccgtcatccattgagatca

SEQ ID NO: 1502 - DNA, 32 bp, synthetic construct
  misc_feature 1..32: note = synthetic oligonucleotide
  source 1..32: mol_type = other DNA
cgacagacgcctgatctcaatcttcgttggct

SEQ ID NO: 1503 - DNA, 25 bp, synthetic construct
  misc_feature 1..25: note = synthetic oligonucleotide
  source 1..25: mol_type = other DNA
gatcagccaacgaagattgagatca

SEQ ID NO: 1504 - DNA, 32 bp, synthetic construct
  misc_feature 1..32: note = synthetic oligonucleotide
  source 1..32: mol_type = other DNA
cgacagacgcctgatctcaatcctttctgcgt

SEQ ID NO: 1505 - DNA, 25 bp, synthetic construct
  misc_feature 1..25: note = synthetic oligonucleotide
  source 1..25: mol_type = other DNA
gatcacgcagaaaggattgagatca

SEQ ID NO: 1506 - DNA, 32 bp, synthetic construct
  misc_feature 1..32: note = synthetic oligonucleotide
  source 1..32: mol_type = other DNA
cgacagacgcctgatctcaagtttgagtggct

SEQ ID NO: 1507 - DNA, 25 bp, synthetic construct
  misc_feature 1..25: note = synthetic oligonucleotide
  source 1..25: mol_type = other DNA
gatcagccactcaaacttgagatca

SEQ ID NO: 1508 - DNA, 32 bp, synthetic construct
  misc_feature 1..32: note = synthetic oligonucleotide
  source 1..32: mol_type = other DNA
cgacagacgcctgatctcaagtagtcggtgtt

SEQ ID NO: 1509 - DNA, 25 bp, synthetic construct
  misc_feature 1..25: note = synthetic oligonucleotide
  source 1..25: mol_type = other DNA
gatcaacaccgactacttgagatca

SEQ ID NO: 1510 - DNA, 32 bp, synthetic construct
  misc_feature 1..32: note = synthetic oligonucleotide
  source 1..32: mol_type = other DNA
cgacagacgcctgatctcaagccttggaaact

SEQ ID NO: 1511 - DNA, 25 bp, synthetic construct
  misc_feature 1..25: note = synthetic oligonucleotide
  source 1..25: mol_type = other DNA
gatcagtttccaaggcttgagatca

SEQ ID NO: 1512 - DNA, 32 bp, synthetic construct
  misc_feature 1..32: note = synthetic oligonucleotide
  source 1..32: mol_type = other DNA
cgacagacgcctgatctcaagcatgtgaggat

SEQ ID NO: 1513 - DNA, 25 bp, synthetic construct
  misc_feature 1..25: note = synthetic oligonucleotide
  source 1..25: mol_type = other DNA
gatcatcctcacatgcttgagatca

SEQ ID NO: 1514 - DNA, 32 bp, synthetic construct
  misc_feature 1..32: note = synthetic oligonucleotide
  source 1..32: mol_type = other DNA
cgacagacgcctgatctcaagattccgtccat

SEQ ID NO: 1515 - DNA, 25 bp, synthetic construct
  misc_feature 1..25: note = synthetic oligonucleotide
  source 1..25: mol_type = other DNA
gatcatggacggaatcttgagatca

SEQ ID NO: 1516 - DNA, 32 bp, synthetic construct
  misc_feature 1..32: note = synthetic oligonucleotide
  source 1..32: mol_type = other DNA
cgacagacgcctgatctcaagaattggagcgt

SEQ ID NO: 1517 - DNA, 25 bp, synthetic construct
  misc_feature 1..25: note = synthetic oligonucleotide
  source 1..25: mol_type = other DNA
gatcacgctccaattcttgagatca

SEQ ID NO: 1518 - DNA, 32 bp, synthetic construct
  misc_feature 1..32: note = synthetic oligonucleotide
  source 1..32: mol_type = other DNA
cgacagacgcctgatctcaagaagtgtgtgct

SEQ ID NO: 1519 - DNA, 25 bp, synthetic construct
  misc_feature 1..25: note = synthetic oligonucleotide
  source 1..25: mol_type = other DNA
gatcagcacacacttcttgagatca

SEQ ID NO: 1520 - DNA, 32 bp, synthetic construct
  misc_feature 1..32: note = synthetic oligonucleotide
  source 1..32: mol_type = other DNA
cgacagacgcctgatctcaagaactggtggat

SEQ ID NO: 1521 - DNA, 25 bp, synthetic construct
  misc_feature 1..25: note = synthetic oligonucleotide
  source 1..25: mol_type = other DNA
gatcatccaccagttcttgagatca

SEQ ID NO: 1522 - DNA, 32 bp, synthetic construct
  misc_feature 1..32: note = synthetic oligonucleotide
  source 1..32: mol_type = other DNA
cgacagacgcctgatctcaactttgatccgct

SEQ ID NO: 1523 - DNA, 25 bp, synthetic construct
  misc_feature 1..25: note = synthetic oligonucleotide
  source 1..25: mol_type = other DNA
gatcagcggatcaaagttgagatca

SEQ ID NO: 1524 - DNA, 32 bp, synthetic construct
  misc_feature 1..32: note = synthetic oligonucleotide
  source 1..32: mol_type = other DNA
cgacagacgcctgatctcaacgtggtttctgt

SEQ ID NO: 1525 - DNA, 25 bp, synthetic construct
  misc_feature 1..25: note = synthetic oligonucleotide
  source 1..25: mol_type = other DNA
gatcacagaaaccacgttgagatca

SEQ ID NO: 1526 - DNA, 32 bp, synthetic construct
  misc_feature 1..32: note = synthetic oligonucleotide
  source 1..32: mol_type = other DNA
cgacagacgcctgatctcaacacctcttggat

SEQ ID NO: 1527 - DNA, 25 bp, synthetic construct
  misc_feature 1..25: note = synthetic oligonucleotide
  source 1..25: mol_type = other DNA
gatcatccaagaggtgttgagatca

SEQ ID NO: 1528 - DNA, 32 bp, synthetic construct
  misc_feature 1..32: note = synthetic oligonucleotide
  source 1..32: mol_type = other DNA
cgacagacgcctgatctcaaattgcctcgtct

SEQ ID NO: 1529 - DNA, 25 bp, synthetic construct
  misc_feature 1..25: note = synthetic oligonucleotide
  source 1..25: mol_type = other DNA
gatcagacgaggcaatttgagatca

SEQ ID NO: 1530 - DNA, 32 bp, synthetic construct
  misc_feature 1..32: note = synthetic oligonucleotide
  source 1..32: mol_type = other DNA
cgacagacgcctgatctcaaatgatgcggagt

SEQ ID NO: 1531 - DNA, 25 bp, synthetic construct
  misc_feature 1..25: note = synthetic oligonucleotide
  source 1..25: mol_type = other DNA
gatcactccgcatcatttgagatca

SEQ ID NO: 1532 - DNA, 32 bp, synthetic construct
  misc_feature 1..32: note = synthetic oligonucleotide
  source 1..32: mol_type = other DNA
cgacagacgcctgatctcaaatccttcgctgt

SEQ ID NO: 1533 - DNA, 25 bp, synthetic construct
  misc_feature 1..25: note = synthetic oligonucleotide
  source 1..25: mol_type = other DNA
gatcacagcgaaggatttgagatca

SEQ ID NO: 1534 - DNA, 32 bp, synthetic construct
  misc_feature 1..32: note = synthetic oligonucleotide
  source 1..32: mol_type = other DNA
cgacagacgcctgatctcaaatcatcggctct

SEQ ID NO: 1535 - DNA, 25 bp, synthetic construct
  misc_feature 1..25: note = synthetic oligonucleotide
  source 1..25: mol_type = other DNA
gatcagagccgatgatttgagatca

SEQ ID NO: 1536 - DNA, 32 bp, synthetic construct
  misc_feature 1..32: note = synthetic oligonucleotide
  source 1..32: mol_type = other DNA
cgacagacgcctgatctcaaatacaggtcgct

SEQ ID NO: 1537 - DNA, 25 bp, synthetic construct
  misc_feature 1..25: note = synthetic oligonucleotide
  source 1..25: mol_type = other DNA
gatcagcgacctgtatttgagatca

SEQ ID NO: 1538 - DNA, 32 bp, synthetic construct
  misc_feature 1..32: note = synthetic oligonucleotide
  source 1..32: mol_type = other DNA
cgacagacgcctgatctcaaataagcggtggt

SEQ ID NO: 1539 - DNA, 25 bp, synthetic construct
  misc_feature 1..25: note = synthetic oligonucleotide
  source 1..25: mol_type = other DNA
gatcaccaccgcttatttgagatca

SEQ ID NO: 1540 - DNA, 32 bp, synthetic construct
  misc_feature 1..32: note = synthetic oligonucleotide
  source 1..32: mol_type = other DNA
cgacagacgcctgatctcaaagaggtttggct

SEQ ID NO: 1541 - DNA, 25 bp, synthetic construct
  misc_feature 1..25: note = synthetic oligonucleotide
  source 1..25: mol_type = other DNA
gatcagccaaacctctttgagatca

SEQ ID NO: 1542 - DNA, 32 bp, synthetic construct
  misc_feature 1..32: note = synthetic oligonucleotide
  source 1..32: mol_type = other DNA
cgacagacgcctgatctcaaacgtgttcctct

SEQ ID NO: 1543 - DNA, 25 bp, synthetic construct
  misc_feature 1..25: note = synthetic oligonucleotide
  source 1..25: mol_type = other DNA
gatcagaggaacacgtttgagatca

SEQ ID NO: 1544 - DNA, 32 bp, synthetic construct
  misc_feature 1..32: note = synthetic oligonucleotide
  source 1..32: mol_type = other DNA
cgacagacgcctgatctatttggcagaggtct

SEQ ID NO: 1545 - DNA, 25 bp, synthetic construct
  misc_feature 1..25: note = synthetic oligonucleotide
  source 1..25: mol_type = other DNA
gatcagacctctgccaaatagatca

SEQ ID NO: 1546 - DNA, 32 bp, synthetic construct
  misc_feature 1..32: note = synthetic oligonucleotide
  source 1..32: mol_type = other DNA
cgacagacgcctgatctatttgaggacacggt

SEQ ID NO: 1547 - DNA, 25 bp, synthetic construct
  misc_feature 1..25: note = synthetic oligonucleotide
  source 1..25: mol_type = other DNA
gatcaccgtgtcctcaaatagatca

SEQ ID NO: 1548 - DNA, 32 bp, synthetic construct
  misc_feature 1..32: note = synthetic oligonucleotide
  source 1..32: mol_type = other DNA
cgacagacgcctgatctatttccggttgaggt

SEQ ID NO: 1549 - DNA, 25 bp, synthetic construct
  misc_feature 1..25: note = synthetic oligonucleotide
  source 1..25: mol_type = other DNA
gatcacctcaaccggaaatagatca

SEQ ID NO: 1550 - DNA, 32 bp, synthetic construct
  misc_feature 1..32: note = synthetic oligonucleotide
  source 1..32: mol_type = other DNA
cgacagacgcctgatctatttatcggagcggt

SEQ ID NO: 1551 - DNA, 25 bp, synthetic construct
  misc_feature 1..25: note = synthetic oligonucleotide
  source 1..25: mol_type = other DNA
gatcaccgctccgataaatagatca

SEQ ID NO: 1552 - DNA, 32 bp, synthetic construct
  misc_feature 1..32: note = synthetic oligonucleotide
  source 1..32: mol_type = other DNA
cgacagacgcctgatctattggcaaggagact

SEQ ID NO: 1553 - DNA, 25 bp, synthetic construct
  misc_feature 1..25: note = synthetic oligonucleotide
  source 1..25: mol_type = other DNA
gatcagtctccttgccaatagatca

SEQ ID NO: 1554 - DNA, 32 bp, synthetic construct
  misc_feature 1..32: note = synthetic oligonucleotide
  source 1..32: mol_type = other DNA
cgacagacgcctgatctattgccaagtcctct

SEQ ID NO: 1555 - DNA, 25 bp, synthetic construct
  misc_feature 1..25: note = synthetic oligonucleotide
  source 1..25: mol_type = other DNA
gatcagaggacttggcaatagatca

SEQ ID NO: 1556 - DNA, 32 bp, synthetic construct
  misc_feature 1..32: note = synthetic oligonucleotide
  source 1..32: mol_type = other DNA
cgacagacgcctgatctattctatggtccgct

SEQ ID NO: 1557 - DNA, 25 bp, synthetic construct
  misc_feature 1..25: note = synthetic oligonucleotide
  source 1..25: mol_type = other DNA
gatcagcggaccatagaatagatca

SEQ ID NO: 1558 - DNA, 32 bp, synthetic construct
  misc_feature 1..32: note = synthetic oligonucleotide
  source 1..32: mol_type = other DNA
cgacagacgcctgatctattccaacgaccagt

SEQ ID NO: 1559 - DNA, 25 bp, synthetic construct
  misc_feature 1..25: note = synthetic oligonucleotide
  source 1..25: mol_type = other DNA
gatcactggtcgttggaatagatca

SEQ ID NO: 1560 - DNA, 32 bp, synthetic construct
  misc_feature 1..32: note = synthetic oligonucleotide
  source 1..32: mol_type = other DNA
cgacagacgcctgatctattatgcgagaggct

SEQ ID NO: 1561 - DNA, 25 bp, synthetic construct
  misc_feature 1..25: note = synthetic oligonucleotide
  source 1..25: mol_type = other DNA
gatcagcctctcgcataatagatca

SEQ ID NO: 1562 - DNA, 32 bp, synthetic construct
  misc_feature 1..32: note = synthetic oligonucleotide
  source 1..32: mol_type = other DNA
cgacagacgcctgatctattaggacacacggt

SEQ ID NO: 1563 - DNA, 25 bp, synthetic construct
  misc_feature 1..25: note = synthetic oligonucleotide
  source 1..25: mol_type = other DNA
gatcaccgtgtgtcctaatagatca

SEQ ID NO: 1564 - DNA, 32 bp, synthetic construct
  misc_feature 1..32: note = synthetic oligonucleotide
  source 1..32: mol_type = other DNA
cgacagacgcctgatctattacgtaccagcct

SEQ ID NO: 1565 - DNA, 25 bp, synthetic construct
  misc_feature 1..25: note = synthetic oligonucleotide
  source 1..25: mol_type = other DNA
gatcaggctggtacgtaatagatca

SEQ ID NO: 1566 - DNA, 32 bp, synthetic construct
  misc_feature 1..32: note = synthetic oligonucleotide
  source 1..32: mol_type = other DNA
cgacagacgcctgatctattacctcagtcgct

SEQ ID NO: 1567 - DNA, 25 bp, synthetic construct
  misc_feature 1..25: note = synthetic oligonucleotide
  source 1..25: mol_type = other DNA
gatcagcgactgaggtaatagatca

SEQ ID NO: 1568 - DNA, 32 bp, synthetic construct
  misc_feature 1..32: note = synthetic oligonucleotide
  source 1..32: mol_type = other DNA
cgacagacgcctgatctattacaaggcgaggt

SEQ ID NO: 1569 - DNA, 25 bp, synthetic construct
  misc_feature 1..25: note = synthetic oligonucleotide
  source 1..25: mol_type = other DNA
gatcacctcgccttgtaatagatca

SEQ ID NO: 1570 - DNA, 32 bp, synthetic construct
  misc_feature 1..32: note = synthetic oligonucleotide
  source 1..32: mol_type = other DNA
cgacagacgcctgatctattaaggcaccacct

SEQ ID NO: 1571 - DNA, 25 bp, synthetic construct
  misc_feature 1..25: note = synthetic oligonucleotide
  source 1..25: mol_type = other DNA
gatcaggtggtgccttaatagatca

SEQ ID NO: 1572 - DNA, 32 bp, synthetic construct
  misc_feature 1..32: note = synthetic oligonucleotide
  source 1..32: mol_type = other DNA
cgacagacgcctgatctattaactgcctccgt

SEQ ID NO: 1573 - DNA, 25 bp, synthetic construct
  misc_feature 1..25: note = synthetic oligonucleotide
  source 1..25: mol_type = other DNA
gatcacggaggcagttaatagatca

SEQ ID NO: 1574 - DNA, 32 bp, synthetic construct
  misc_feature 1..32: note = synthetic oligonucleotide
  source 1..32: mol_type = other DNA
cgacagacgcctgatctatgtttcaggtcggt

SEQ ID NO: 1575 - DNA, 25 bp, synthetic construct
  misc_feature 1..25: note = synthetic oligonucleotide
  source 1..25: mol_type = other DNA
gatcaccgacctgaaacatagatca

SEQ ID NO: 1576 - DNA, 32 bp, synthetic construct
  misc_feature 1..32: note = synthetic oligonucleotide
  source 1..32: mol_type = other DNA
cgacagacgcctgatctatgttagacgcaggt

SEQ ID NO: 1577 - DNA, 25 bp, synthetic construct
  misc_feature 1..25: note = synthetic oligonucleotide
  source 1..25: mol_type = other DNA
gatcacctgcgtctaacatagatca

SEQ ID NO: 1578 - DNA, 32 bp, synthetic construct
  misc_feature 1..32: note = synthetic oligonucleotide
  source 1..32: mol_type = other DNA
cgacagacgcctgatctatgtgtatcaggcgt

SEQ ID NO: 1579 - DNA, 25 bp, synthetic construct
  misc_feature 1..25: note = synthetic oligonucleotide
  source 1..25: mol_type = other DNA
gatcacgcctgatacacatagatca

SEQ ID NO: 1580 - DNA, 32 bp, synthetic construct
  misc_feature 1..32: note = synthetic oligonucleotide
  source 1..32: mol_type = other DNA
cgacagacgcctgatctatggttactgctcgt

SEQ ID NO: 1581 - DNA, 25 bp, synthetic construct
  misc_feature 1..25: note = synthetic oligonucleotide
  source 1..25: mol_type = other DNA
gatcacgagcagtaaccatagatca

SEQ ID NO: 1582 - DNA, 32 bp, synthetic construct
  misc_feature 1..32: note = synthetic oligonucleotide
  source 1..32: mol_type = other DNA
cgacagacgcctgatctatggaggctttgtct

SEQ ID NO: 1583 - DNA, 25 bp, synthetic construct
  misc_feature 1..25: note = synthetic oligonucleotide
  source 1..25: mol_type = other DNA
gatcagacaaagcctccatagatca

SEQ ID NO: 1584 - DNA, 32 bp, synthetic construct
  misc_feature 1..32: note = synthetic oligonucleotide
  source 1..32: mol_type = other DNA
cgacagacgcctgatctatgcttgtggactct

SEQ ID NO: 1585 - DNA, 25 bp, synthetic construct
  misc_feature 1..25: note = synthetic oligonucleotide
  source 1..25: mol_type = other DNA
gatcagagtccacaagcatagatca

SEQ ID NO: 1586 - DNA, 32 bp, synthetic construct
  misc_feature 1..32: note = synthetic oligonucleotide
  source 1..32: mol_type = other DNA
cgacagacgcctgatctatgctaaaggtcggt

SEQ ID NO: 1587 - DNA, 25 bp, synthetic construct
  misc_feature 1..25: note = synthetic oligonucleotide
  source 1..25: mol_type = other DNA
gatcaccgacctttagcatagatca

SEQ ID NO: 1588 - DNA, 32 bp, synthetic construct
  misc_feature 1..32: note = synthetic oligonucleotide
  source 1..32: mol_type = other DNA
cgacagacgcctgatctatgcctttacctcgt

SEQ ID NO: 1589 - DNA, 25 bp, synthetic construct
  misc_feature 1..25: note = synthetic oligonucleotide
  source 1..25: mol_type = other DNA
gatcacgaggtaaaggcatagatca

SEQ ID NO: 1590 - DNA, 32 bp, synthetic construct
  misc_feature 1..32: note = synthetic oligonucleotide
  source 1..32: mol_type = other DNA
cgacagacgcctgatctatgatgtctgtgcct

SEQ ID NO: 1591 - DNA, 25 bp, synthetic construct
  misc_feature 1..25: note = synthetic oligonucleotide
  source 1..25: mol_type = other DNA
gatcaggcacagacatcatagatca

SEQ ID NO: 1592 - DNA, 32 bp, synthetic construct
  misc_feature 1..32: note = synthetic oligonucleotide
  source 1..32: mol_type = other DNA
cgacagacgcctgatctatgagaagccagtgt

SEQ ID NO: 1593 - DNA, 25 bp, synthetic construct
  misc_feature 1..25: note = synthetic oligonucleotide
  source 1..25: mol_type = other DNA
gatcacactggcttctcatagatca

SEQ ID NO: 1594 - DNA, 32 bp, synthetic construct
  misc_feature 1..32: note = synthetic oligonucleotide
  source 1..32: mol_type = other DNA
cgacagacgcctgatctatgacctgttgtggt

SEQ ID NO: 1595 - DNA, 25 bp, synthetic construct
  misc_feature 1..25: note = synthetic oligonucleotide
  source 1..25: mol_type = other DNA
gatcaccacaacaggtcatagatca

SEQ ID NO: 1596 - DNA, 32 bp, synthetic construct
  misc_feature 1..32: note = synthetic oligonucleotide
  source 1..32: mol_type = other DNA
cgacagacgcctgatctatgaagtcacgaggt

SEQ ID NO: 1597 - DNA, 25 bp, synthetic construct
  misc_feature 1..25: note = synthetic oligonucleotide
  source 1..25: mol_type = other DNA
gatcacctcgtgacttcatagatca

SEQ ID NO: 1598 - DNA, 32 bp, synthetic construct
  misc_feature 1..32: note = synthetic oligonucleotide
  source 1..32: mol_type = other DNA
cgacagacgcctgatctatcttgaggtgtgct

SEQ ID NO: 1599 - DNA, 25 bp, synthetic construct
  misc_feature 1..25: note = synthetic oligonucleotide
  source 1..25: mol_type = other DNA
gatcagcacacctcaagatagatca

SEQ ID NO: 1600 - DNA, 32 bp, synthetic construct
  misc_feature 1..32: note = synthetic oligonucleotide
  source 1..32: mol_type = other DNA
cgacagacgcctgatctatcttcgacactggt

SEQ ID NO: 1601 - DNA, 25 bp, synthetic construct
  misc_feature 1..25: note = synthetic oligonucleotide
  source 1..25: mol_type = other DNA
gatcaccagtgtcgaagatagatca

SEQ ID NO: 1602 - DNA, 32 bp, synthetic construct
  misc_feature 1..32: note = synthetic oligonucleotide
  source 1..32: mol_type = other DNA
cgacagacgcctgatctatctccaagcacagt

SEQ ID NO: 1603 - DNA, 25 bp, synthetic construct
  misc_feature 1..25: note = synthetic oligonucleotide
  source 1..25: mol_type = other DNA
gatcactgtgcttggagatagatca

SEQ ID NO: 1604 - DNA, 32 bp, synthetic construct
  misc_feature 1..32: note = synthetic oligonucleotide
  source 1..32: mol_type = other DNA
cgacagacgcctgatctatctaccgaacacgt

SEQ ID NO: 1605 - DNA, 25 bp, synthetic construct
  misc_feature 1..25: note = synthetic oligonucleotide
  source 1..25: mol_type = other DNA
gatcacgtgttcggtagatagatca

SEQ ID NO: 1606 - DNA, 32 bp, synthetic construct
  misc_feature 1..32: note = synthetic oligonucleotide
  source 1..32: mol_type = other DNA
cgacagacgcctgatctatcgaatgagcaggt

SEQ ID NO: 1607 - DNA, 25 bp, synthetic construct
  misc_feature 1..25: note = synthetic oligonucleotide
  source 1..25: mol_type = other DNA
gatcacctgctcattcgatagatca

SEQ ID NO: 1608 - DNA, 32 bp, synthetic construct
  misc_feature 1..32: note = synthetic oligonucleotide
  source 1..32: mol_type = other DNA
cgacagacgcctgatctatccgtattgagcct

SEQ ID NO: 1609 - DNA, 25 bp, synthetic construct
  misc_feature 1..25: note = synthetic oligonucleotide
  source 1..25: mol_type = other DNA
gatcaggctcaatacggatagatca

SEQ ID NO: 1610 - DNA, 32 bp, synthetic construct
  misc_feature 1..32: note = synthetic oligonucleotide
  source 1..32: mol_type = other DNA
cgacagacgcctgatctatccatgagcaacct

SEQ ID NO: 1611 - DNA, 25 bp, synthetic construct
  misc_feature 1..25: note = synthetic oligonucleotide
  source 1..25: mol_type = other DNA
gatcaggttgctcatggatagatca

SEQ ID NO: 1612 - DNA, 32 bp, synthetic construct
  misc_feature 1..32: note = synthetic oligonucleotide
  source 1..32: mol_type = other DNA
cgacagacgcctgatctatcatgcctaaccgt

SEQ ID NO: 1613 - DNA, 25 bp, synthetic construct
  misc_feature 1..25: note = synthetic oligonucleotide
  source 1..25: mol_type = other DNA
gatcacggttaggcatgatagatca

SEQ ID NO: 1614 - DNA, 32 bp, synthetic construct
  misc_feature 1..32: note = synthetic oligonucleotide
  source 1..32: mol_type = other DNA
cgacagacgcctgatctatcaggtgaatggct

SEQ ID NO: 1615 - DNA, 25 bp, synthetic construct
  misc_feature 1..25: note = synthetic oligonucleotide
  source 1..25: mol_type = other DNA
gatcagccattcacctgatagatca

SEQ ID NO: 1616 - DNA, 32 bp, synthetic construct
  misc_feature 1..32: note = synthetic oligonucleotide
  source 1..32: mol_type = other DNA
cgacagacgcctgatctatcaccatgttccgt

SEQ ID NO: 1617 - DNA, 25 bp, synthetic construct
  misc_feature 1..25: note = synthetic oligonucleotide
  source 1..25: mol_type = other DNA
gatcacggaacatggtgatagatca

SEQ ID NO: 1618 - DNA, 32 bp, synthetic construct
  misc_feature 1..32: note = synthetic oligonucleotide
  source 1..32: mol_type = other DNA
cgacagacgcctgatctatcaacagtccagct

SEQ ID NO: 1619 - DNA, 25 bp, synthetic construct
  misc_feature 1..25: note = synthetic oligonucleotide
  source 1..25: mol_type = other DNA
gatcagctggactgttgatagatca

SEQ ID NO: 1620 - DNA, 32 bp, synthetic construct
  misc_feature 1..32: note = synthetic oligonucleotide
  source 1..32: mol_type = other DNA
cgacagacgcctgatctatattaccgcgacct

SEQ ID NO: 1621 - DNA, 25 bp, synthetic construct
  misc_feature 1..25: note = synthetic oligonucleotide
  source 1..25: mol_type = other DNA
gatcaggtcgcggtaatatagatca

SEQ ID NO: 1622 - DNA, 32 bp, synthetic construct
  misc_feature 1..32: note = synthetic oligonucleotide
  source 1..32: mol_type = other DNA
cgacagacgcctgatctatatggacgaacggt

SEQ ID NO: 1623 - DNA, 25 bp, synthetic construct
  misc_feature 1..25: note = synthetic oligonucleotide
  source 1..25: mol_type = other DNA
gatcaccgttcgtccatatagatca

SEQ ID NO: 1624 - DNA, 32 bp, synthetic construct
  misc_feature 1..32: note = synthetic oligonucleotide
  source 1..32: mol_type = other DNA
cgacagacgcctgatctatatgcggtgtctgt

SEQ ID NO: 1625 - DNA, 25 bp, synthetic construct
  misc_feature 1..25: note = synthetic oligonucleotide
  source 1..25: mol_type = other DNA
gatcacagacaccgcatatagatca

SEQ ID NO: 1626 - DNA, 32 bp, synthetic construct
  misc_feature 1..32: note = synthetic oligonucleotide
  source 1..32: mol_type = other DNA
cgacagacgcctgatctatatctcgtgtgcct

SEQ ID NO: 1627 - DNA, 25 bp, synthetic construct
  misc_feature 1..25: note = synthetic oligonucleotide
  source 1..25: mol_type = other DNA
gatcaggcacacgagatatagatca

SEQ ID NO: 1628 - DNA, 32 bp, synthetic construct
  misc_feature 1..32: note = synthetic oligonucleotide
  source 1..32: mol_type = other DNA
cgacagacgcctgatctatatccaaccagcgt

SEQ ID NO: 1629 - DNA, 25 bp, synthetic construct
  misc_feature 1..25: note = synthetic oligonucleotide
  source 1..25: mol_type = other DNA
gatcacgctggttggatatagatca

SEQ ID NO: 1630 - DNA, 32 bp, synthetic construct
  misc_feature 1..32: note = synthetic oligonucleotide
  source 1..32: mol_type = other DNA
cgacagacgcctgatctatataaggcaggcgt

SEQ ID NO: 1631 - DNA, 25 bp, synthetic construct
  misc_feature 1..25: note = synthetic oligonucleotide
  source 1..25: mol_type = other DNA
gatcacgcctgccttatatagatca

SEQ ID NO: 1632 - DNA, 32 bp, synthetic construct
  misc_feature 1..32: note = synthetic oligonucleotide
  source 1..32: mol_type = other DNA
cgacagacgcctgatctatagtgcaagtcggt

SEQ ID NO: 1633 - DNA, 25 bp, synthetic construct
  misc_feature 1..25: note = synthetic oligonucleotide
  source 1..25: mol_type = other DNA
gatcaccgacttgcactatagatca

SEQ ID NO: 1634 - DNA, 32 bp, synthetic construct
  misc_feature 1..32: note = synthetic oligonucleotide
  source 1..32: mol_type = other DNA
cgacagacgcctgatctatagtgagaacggct

SEQ ID NO: 1635 - DNA, 25 bp, synthetic construct
  misc_feature 1..25: note = synthetic oligonucleotide
  source 1..25: mol_type = other DNA
gatcagccgttctcactatagatca

SEQ ID NO: 1636 - DNA, 32 bp, synthetic construct
  misc_feature 1..32: note = synthetic oligonucleotide
  source 1..32: mol_type = other DNA
cgacagacgcctgatctataggcaggtttcgt

SEQ ID NO: 1637 - DNA, 25 bp, synthetic construct
  misc_feature 1..25: note = synthetic oligonucleotide
  source 1..25: mol_type = other DNA
gatcacgaaacctgcctatagatca

SEQ ID NO: 1638 - DNA, 32 bp, synthetic construct
  misc_feature 1..32: note = synthetic oligonucleotide
  source 1..32: mol_type = other DNA
cgacagacgcctgatctatagatcgatggcgt

SEQ ID NO: 1639 - DNA, 25 bp, synthetic construct
  misc_feature 1..25: note = synthetic oligonucleotide
  source 1..25: mol_type = other DNA
gatcacgccatcgatctatagatca

SEQ ID NO: 1640 - DNA, 32 bp, synthetic construct
  misc_feature 1..32: note = synthetic oligonucleotide
  source 1..32: mol_type = other DNA
cgacagacgcctgatctatactctgttccgct

SEQ ID NO: 1641 - DNA, 25 bp, synthetic construct
  misc_feature 1..25: note = synthetic oligonucleotide
  source 1..25: mol_type = other DNA
gatcagcggaacagagtatagatca

SEQ ID NO: 1642 - DNA, 32 bp, synthetic construct
  misc_feature 1..32: note = synthetic oligonucleotide
  source 1..32: mol_type = other DNA
cgacagacgcctgatctatactaacggacgct

SEQ ID NO: 1643 - DNA, 25 bp, synthetic construct
  misc_feature 1..25: note = synthetic oligonucleotide
  source 1..25: mol_type = other DNA
gatcagcgtccgttagtatagatca

SEQ ID NO: 1644 - DNA, 32 bp, synthetic construct
  misc_feature 1..32: note = synthetic oligonucleotide
  source 1..32: mol_type = other DNA
cgacagacgcctgatctatacgttctgctcct

SEQ ID NO: 1645 - DNA, 25 bp, synthetic construct
  misc_feature 1..25: note = synthetic oligonucleotide
  source 1..25: mol_type = other DNA
gatcaggagcagaacgtatagatca

SEQ ID NO: 1646 - DNA, 32 bp, synthetic construct
  misc_feature 1..32: note = synthetic oligonucleotide
  source 1..32: mol_type = other DNA
cgacagacgcctgatctataatctcgaccgct

SEQ ID NO: 1647 - DNA, 25 bp, synthetic construct
  misc_feature 1..25: note = synthetic oligonucleotide
  source 1..25: mol_type = other DNA
gatcagcggtcgagattatagatca

SEQ ID NO: 1648 - DNA, 32 bp, synthetic construct
  misc_feature 1..32: note = synthetic oligonucleotide
  source 1..32: mol_type = other DNA
cgacagacgcctgatctataagcggagtgtct

SEQ ID NO: 1649 - DNA, 25 bp, synthetic construct
  misc_feature 1..25: note = synthetic oligonucleotide
  source 1..25: mol_type = other DNA
gatcagacactccgcttatagatca

SEQ ID NO: 1650 - DNA, 32 bp, synthetic construct
  misc_feature 1..32: note = synthetic oligonucleotide
  source 1..32: mol_type = other DNA
cgacagacgcctgatctataagcctggaacgt

SEQ ID NO: 1651 - DNA, 25 bp, synthetic construct
  misc_feature 1..25: note = synthetic oligonucleotide
  source 1..25: mol_type = other DNA
gatcacgttccaggcttatagatca

SEQ ID NO: 1652 - DNA, 32 bp, synthetic construct
  misc_feature 1..32: note = synthetic oligonucleotide
  source 1..32: mol_type = other DNA
cgacagacgcctgatctataagacggtgagct

SEQ ID NO: 1653 - DNA, 25 bp, synthetic construct
  misc_feature 1..25: note = synthetic oligonucleotide
  source 1..25: mol_type = other DNA
gatcagctcaccgtcttatagatca

SEQ ID NO: 1654 - DNA, 32 bp, synthetic construct
  misc_feature 1..32: note = synthetic oligonucleotide
  source 1..32: mol_type = other DNA
cgacagacgcctgatctataagaacctccgct

SEQ ID NO: 1655 - DNA, 25 bp, synthetic construct
  misc_feature 1..25: note = synthetic oligonucleotide
  source 1..25: mol_type = other DNA
gatcagcggaggttcttatagatca

SEQ ID NO: 1656 - DNA, 32 bp, synthetic construct
  misc_feature 1..32: note = synthetic oligonucleotide
  source 1..32: mol_type = other DNA
cgacagacgcctgatctataaatggccggagt

SEQ ID NO: 1657 - DNA, 25 bp, synthetic construct
  misc_feature 1..25: note = synthetic oligonucleotide
  source 1..25: mol_type = other DNA
gatcactccggccatttatagatca

SEQ ID NO: 1658 - DNA, 32 bp, synthetic construct
  misc_feature 1..32: note = synthetic oligonucleotide
  source 1..32: mol_type = other DNA
cgacagacgcctgatctagttggcctgaaagt

SEQ ID NO: 1659 - DNA, 25 bp, synthetic construct
  misc_feature 1..25: note = synthetic oligonucleotide
  source 1..25: mol_type = other DNA
gatcactttcaggccaactagatca

SEQ ID NO: 1660 - DNA, 32 bp, synthetic construct
  misc_feature 1..32: note = synthetic oligonucleotide
  source 1..32: mol_type = other DNA
cgacagacgcctgatctagttgcatctctggt

SEQ ID NO: 1661 - DNA, 25 bp, synthetic construct
  misc_feature 1..25: note = synthetic oligonucleotide
  source 1..25: mol_type = other DNA
gatcaccagagatgcaactagatca

SEQ ID NO: 1662 - DNA, 32 bp, synthetic construct
  misc_feature 1..32: note = synthetic oligonucleotide
  source 1..32: mol_type = other DNA
cgacagacgcctgatctagttctccgacttgt

SEQ ID NO: 1663 - DNA, 25 bp, synthetic construct
  misc_feature 1..25: note = synthetic oligonucleotide
  source 1..25: mol_type = other DNA
gatcacaagtcggagaactagatca

SEQ ID NO: 1664 - DNA, 32 bp, synthetic construct
  misc_feature 1..32: note = synthetic oligonucleotide
  source 1..32: mol_type = other DNA
cgacagacgcctgatctagttctcaaccagct

SEQ ID NO: 1665 - DNA, 25 bp, synthetic construct
  misc_feature 1..25: note = synthetic oligonucleotide
  source 1..25: mol_type = other DNA
gatcagctggttgagaactagatca

SEQ ID NO: 1666 - DNA, 32 bp, synthetic construct
  misc_feature 1..32: note = synthetic oligonucleotide
  source 1..32: mol_type = other DNA
cgacagacgcctgatctagttatggaagccgt

SEQ ID NO: 1667 - DNA, 25 bp, synthetic construct
  misc_feature 1..25: note = synthetic oligonucleotide
  source 1..25: mol_type = other DNA
gatcacggcttccataactagatca

SEQ ID NO: 1668 - DNA, 32 bp, synthetic construct
  misc_feature 1..32: note = synthetic oligonucleotide
  source 1..32: mol_type = other DNA
cgacagacgcctgatctagtgtctaatgcggt

SEQ ID NO: 1669 - DNA, 25 bp, synthetic construct
  misc_feature 1..25: note = synthetic oligonucleotide
  source 1..25: mol_type = other DNA
gatcaccgcattagacactagatca

SEQ ID NO: 1670 - DNA, 32 bp, synthetic construct
  misc_feature 1..32: note = synthetic oligonucleotide
  source 1..32: mol_type = other DNA
cgacagacgcctgatctagtggtttcgtcagt

SEQ ID NO: 1671 - DNA, 25 bp, synthetic construct
  misc_feature 1..25: note = synthetic oligonucleotide
  source 1..25: mol_type = other DNA
gatcactgacgaaaccactagatca

SEQ ID NO: 1672 - DNA, 32 bp, synthetic construct
  misc_feature 1..32: note = synthetic oligonucleotide
  source 1..32: mol_type = other DNA
cgacagacgcctgatctagtcggaacctttgt

SEQ ID NO: 1673 - DNA, 25 bp, synthetic construct
  misc_feature 1..25: note = synthetic oligonucleotide
  source 1..25: mol_type = other DNA
gatcacaaaggttccgactagatca

SEQ ID NO: 1674 - DNA, 32 bp, synthetic construct
  misc_feature 1..32: note = synthetic oligonucleotide
  source 1..32: mol_type = other DNA
cgacagacgcctgatctagtcaacgacatcct

SEQ ID NO: 1675 - DNA, 25 bp, synthetic construct
  misc_feature 1..25: note = synthetic oligonucleotide
  source 1..25: mol_type = other DNA
gatcaggatgtcgttgactagatca

SEQ ID NO: 1676 - DNA, 32 bp, synthetic construct
  misc_feature 1..32: note = synthetic oligonucleotide
  source 1..32: mol_type = other DNA
cgacagacgcctgatctagtcaacaccagtct

SEQ ID NO: 1677 - DNA, 25 bp, synthetic construct
  misc_feature 1..25: note = synthetic oligonucleotide
  source 1..25: mol_type = other DNA
gatcagactggtgttgactagatca

SEQ ID NO: 1678 - DNA, 32 bp, synthetic construct
  misc_feature 1..32: note = synthetic oligonucleotide
  source 1..32: mol_type = other DNA
cgacagacgcctgatctagtatagccaccgat

SEQ ID NO: 1679 - DNA, 25 bp, synthetic construct
  misc_feature 1..25: note = synthetic oligonucleotide
  source 1..25: mol_type = other DNA
gatcatcggtggctatactagatca

SEQ ID NO: 1680 - DNA, 32 bp, synthetic construct
  misc_feature 1..32: note = synthetic oligonucleotide
  source 1..32: mol_type = other DNA
cgacagacgcctgatctagtagtacgaggcat

SEQ ID NO: 1681 - DNA, 25 bp, synthetic construct
  misc_feature 1..25: note = synthetic oligonucleotide
  source 1..25: mol_type = other DNA
gatcatgcctcgtactactagatca

SEQ ID NO: 1682 - DNA, 32 bp, synthetic construct
  misc_feature 1..32: note = synthetic oligonucleotide
  source 1..32: mol_type = other DNA
cgacagacgcctgatctagtagaacatgcggt

SEQ ID NO: 1683 - DNA, 25 bp, synthetic construct
  misc_feature 1..25: note = synthetic oligonucleotide
  source 1..25: mol_type = other DNA
gatcaccgcatgttctactagatca

SEQ ID NO: 1684 - DNA, 32 bp, synthetic construct
  misc_feature 1..32: note = synthetic oligonucleotide
  source 1..32: mol_type = other DNA
cgacagacgcctgatctagtactgtgcttggt

SEQ ID NO: 1685 - DNA, 25 bp, synthetic construct
  misc_feature 1..25: note = synthetic oligonucleotide
  source 1..25: mol_type = other DNA
gatcaccaagcacagtactagatca

SEQ ID NO: 1686 - DNA, 32 bp, synthetic construct
  misc_feature 1..32: note = synthetic oligonucleotide
  source 1..32: mol_type = other DNA
cgacagacgcctgatctagtacacatcaccgt

SEQ ID NO: 1687 - DNA, 25 bp, synthetic construct
  misc_feature 1..25: note = synthetic oligonucleotide
  source 1..25: mol_type = other DNA
gatcacggtgatgtgtactagatca

SEQ ID NO: 1688 - DNA, 32 bp, synthetic construct
  misc_feature 1..32: note = synthetic oligonucleotide
  source 1..32: mol_type = other DNA
cgacagacgcctgatctaggtttacgccttct

SEQ ID NO: 1689 - DNA, 25 bp, synthetic construct
  misc_feature 1..25: note = synthetic oligonucleotide
  source 1..25: mol_type = other DNA
gatcagaaggcgtaaacctagatca

SEQ ID NO: 1690 - DNA, 32 bp, synthetic construct
  misc_feature 1..32: note = synthetic oligonucleotide
  source 1..32: mol_type = other DNA
cgacagacgcctgatctaggttcttagcgtgt

SEQ ID NO: 1691 - DNA, 25 bp, synthetic construct
  misc_feature 1..25: note = synthetic oligonucleotide
  source 1..25: mol_type = other DNA
gatcacacgctaagaacctagatca

SEQ ID NO: 1692 - DNA, 32 bp, synthetic construct
  misc_feature 1..32: note = synthetic oligonucleotide
  source 1..32: mol_type = other DNA
cgacagacgcctgatctaggctttatccgtgt

SEQ ID NO: 1693 - DNA, 25 bp, synthetic construct
  misc_feature 1..25: note = synthetic oligonucleotide
  source 1..25: mol_type = other DNA
gatcacacggataaagcctagatca

SEQ ID NO: 1694 - DNA, 32 bp, synthetic construct
  misc_feature 1..32: note = synthetic oligonucleotide
  source 1..32: mol_type = other DNA
cgacagacgcctgatctaggcttcttcacact

SEQ ID NO: 1695 - DNA, 25 bp, synthetic construct
  misc_feature 1..25: note = synthetic oligonucleotide
  source 1..25: mol_type = other DNA
gatcagtgtgaagaagcctagatca

SEQ ID NO: 1696 - DNA, 32 bp, synthetic construct
  misc_feature 1..32: note = synthetic oligonucleotide
  source 1..32: mol_type = other DNA
cgacagacgcctgatctaggcaaagttcaggt

SEQ ID NO: 1697 - DNA, 25 bp, synthetic construct
  misc_feature 1..25: note = synthetic oligonucleotide
  source 1..25: mol_type = other DNA
gatcacctgaactttgcctagatca

SEQ ID NO: 1698 - DNA, 32 bp, synthetic construct
  misc_feature 1..32: note = synthetic oligonucleotide
  source 1..32: mol_type = other DNA
cgacagacgcctgatctaggaccttaccacat

SEQ ID NO: 1699 - DNA, 25 bp, synthetic construct
  misc_feature 1..25: note = synthetic oligonucleotide
  source 1..25: mol_type = other DNA
gatcatgtggtaaggtcctagatca

SEQ ID NO: 1700 - DNA, 32 bp, synthetic construct
  misc_feature 1..32: note = synthetic oligonucleotide
  source 1..32: mol_type = other DNA
cgacagacgcctgatctaggaatgtatcggct

SEQ ID NO: 1701 - DNA, 25 bp, synthetic construct
  misc_feature 1..25: note = synthetic oligonucleotide
  source 1..25: mol_type = other DNA
gatcagccgatacattcctagatca

SEQ ID NO: 1702 - DNA, 32 bp, synthetic construct
  misc_feature 1..32: note = synthetic oligonucleotide
  source 1..32: mol_type = other DNA
cgacagacgcctgatctaggaatcatcagcgt

SEQ ID NO: 1703 - DNA, 25 bp, synthetic construct
  misc_feature 1..25: note = synthetic oligonucleotide
  source 1..25: mol_type = other DNA
gatcacgctgatgattcctagatca

SEQ ID NO: 1704 - DNA, 32 bp, synthetic construct
  misc_feature 1..32: note = synthetic oligonucleotide
  source 1..32: mol_type = other DNA
cgacagacgcctgatctagctccatttaccgt

SEQ ID NO: 1705 - DNA, 25 bp, synthetic construct
  misc_feature 1..25: note = synthetic oligonucleotide
  source 1..25: mol_type = other DNA
gatcacggtaaatggagctagatca

SEQ ID NO: 1706 - DNA, 32 bp, synthetic construct
  misc_feature 1..32: note = synthetic oligonucleotide
  source 1..32: mol_type = other DNA
cgacagacgcctgatctagctaaagcaggtct

SEQ ID NO: 1707 - DNA, 25 bp, synthetic construct
  misc_feature 1..25: note = synthetic oligonucleotide
  source 1..25: mol_type = other DNA
gatcagacctgctttagctagatca

SEQ ID NO: 1708 - DNA, 32 bp, synthetic construct
  misc_feature 1..32: note = synthetic oligonucleotide
  source 1..32: mol_type = other DNA
cgacagacgcctgatctagcgtttactgaggt

SEQ ID NO: 1709 - DNA, 25 bp, synthetic construct
  misc_feature 1..25: note = synthetic oligonucleotide
  source 1..25: mol_type = other DNA
gatcacctcagtaaacgctagatca

SEQ ID NO: 1710 - DNA, 32 bp, synthetic construct
  misc_feature 1..32: note = synthetic oligonucleotide
  source 1..32: mol_type = other DNA
cgacagacgcctgatctagcctttgtcactct

SEQ ID NO: 1711 - DNA, 25 bp, synthetic construct
  misc_feature 1..25: note = synthetic oligonucleotide
  source 1..25: mol_type = other DNA
gatcagagtgacaaaggctagatca

SEQ ID NO: 1712 - DNA, 32 bp, synthetic construct
  misc_feature 1..32: note = synthetic oligonucleotide
  source 1..32: mol_type = other DNA
cgacagacgcctgatctagccttcattcctgt

SEQ ID NO: 1713 - DNA, 25 bp, synthetic construct
  misc_feature 1..25: note = synthetic oligonucleotide
  source 1..25: mol_type = other DNA
gatcacaggaatgaaggctagatca

SEQ ID NO: 1714 - DNA, 32 bp, synthetic construct
  misc_feature 1..32: note = synthetic oligonucleotide
  source 1..32: mol_type = other DNA
cgacagacgcctgatctagcctattgttccgt

SEQ ID NO: 1715 - DNA, 25 bp, synthetic construct
  misc_feature 1..25: note = synthetic oligonucleotide
  source 1..25: mol_type = other DNA
gatcacggaacaataggctagatca

SEQ ID NO: 1716 - DNA, 32 bp, synthetic construct
  misc_feature 1..32: note = synthetic oligonucleotide
  source 1..32: mol_type = other DNA
cgacagacgcctgatctagcctatacaccgat

SEQ ID NO: 1717 - DNA, 25 bp, synthetic construct
  misc_feature 1..25: note = synthetic oligonucleotide
  source 1..25: mol_type = other DNA
gatcatcggtgtataggctagatca

SEQ ID NO: 1718 - DNA, 32 bp, synthetic construct
  misc_feature 1..32: note = synthetic oligonucleotide
  source 1..32: mol_type = other DNA
cgacagacgcctgatctagcctaaaccactgt

SEQ ID NO: 1719 - DNA, 25 bp, synthetic construct
  misc_feature 1..25: note = synthetic oligonucleotide
  source 1..25: mol_type = other DNA
gatcacagtggtttaggctagatca

SEQ ID NO: 1720 - DNA, 32 bp, synthetic construct
  misc_feature 1..32: note = synthetic oligonucleotide
  source 1..32: mol_type = other DNA
cgacagacgcctgatctagccaaagtatccgt

SEQ ID NO: 1721 - DNA, 25 bp, synthetic construct
  misc_feature 1..25: note = synthetic oligonucleotide
  source 1..25: mol_type = other DNA
gatcacggatactttggctagatca

SEQ ID NO: 1722 - DNA, 32 bp, synthetic construct
  misc_feature 1..32: note = synthetic oligonucleotide
  source 1..32: mol_type = other DNA
cgacagacgcctgatctagcattgtctcacct

SEQ ID NO: 1723 - DNA, 25 bp, synthetic construct
  misc_feature 1..25: note = synthetic oligonucleotide
  source 1..25: mol_type = other DNA
gatcaggtgagacaatgctagatca

SEQ ID NO: 1724 - DNA, 32 bp, synthetic construct
  misc_feature 1..32: note = synthetic oligonucleotide
  source 1..32: mol_type = other DNA
cgacagacgcctgatctagcatagtgaaccgt

SEQ ID NO: 1725 - DNA, 25 bp, synthetic construct
  misc_feature 1..25: note = synthetic oligonucleotide
  source 1..25: mol_type = other DNA
gatcacggttcactatgctagatca

SEQ ID NO: 1726 - DNA, 32 bp, synthetic construct
  misc_feature 1..32: note = synthetic oligonucleotide
  source 1..32: mol_type = other DNA
cgacagacgcctgatctagcaactaccatcgt

SEQ ID NO: 1727 - DNA, 25 bp, synthetic construct
  misc_feature 1..25: note = synthetic oligonucleotide
  source 1..25: mol_type = other DNA
gatcacgatggtagttgctagatca

SEQ ID NO: 1728 - DNA, 32 bp, synthetic construct
  misc_feature 1..32: note = synthetic oligonucleotide
  source 1..32: mol_type = other DNA
cgacagacgcctgatctagcaacatctacggt

SEQ ID NO: 1729 - DNA, 25 bp, synthetic construct
  misc_feature 1..25: note = synthetic oligonucleotide
  source 1..25: mol_type = other DNA
gatcaccgtagatgttgctagatca

SEQ ID NO: 1730 - DNA, 32 bp, synthetic construct
  misc_feature 1..32: note = synthetic oligonucleotide
  source 1..32: mol_type = other DNA
cgacagacgcctgatctagcaaagtggagtct

SEQ ID NO: 1731 - DNA, 25 bp, synthetic construct
  misc_feature 1..25: note = synthetic oligonucleotide
  source 1..25: mol_type = other DNA
gatcagactccactttgctagatca

SEQ ID NO: 1732 - DNA, 32 bp, synthetic construct
  misc_feature 1..32: note = synthetic oligonucleotide
  source 1..32: mol_type = other DNA
cgacagacgcctgatctagatgtggtgttcct

SEQ ID NO: 1733 - DNA, 25 bp, synthetic construct
  misc_feature 1..25: note = synthetic oligonucleotide
  source 1..25: mol_type = other DNA
gatcaggaacaccacatctagatca

SEQ ID NO: 1734 - DNA, 32 bp, synthetic construct
  misc_feature 1..32: note = synthetic oligonucleotide
  source 1..32: mol_type = other DNA
cgacagacgcctgatctagatgtaagtgccgt

SEQ ID NO: 1735 - DNA, 25 bp, synthetic construct
  misc_feature 1..25: note = synthetic oligonucleotide
  source 1..25: mol_type = other DNA
gatcacggcacttacatctagatca

SEQ ID NO: 1736 - DNA, 32 bp, synthetic construct
  misc_feature 1..32: note = synthetic oligonucleotide
  source 1..32: mol_type = other DNA
cgacagacgcctgatctagatgccttccttgt

SEQ ID NO: 1737 - DNA, 25 bp, synthetic construct
  misc_feature 1..25: note = synthetic oligonucleotide
  source 1..25: mol_type = other DNA
gatcacaaggaaggcatctagatca

SEQ ID NO: 1738 - DNA, 32 bp, synthetic construct
  misc_feature 1..32: note = synthetic oligonucleotide
  source 1..32: mol_type = other DNA
cgacagacgcctgatctagatgattccggtgt

SEQ ID NO: 1739 - DNA, 25 bp, synthetic construct
  misc_feature 1..25: note = synthetic oligonucleotide
  source 1..25: mol_type = other DNA
gatcacaccggaatcatctagatca

SEQ ID NO: 1740 - DNA, 32 bp, synthetic construct
  misc_feature 1..32: note = synthetic oligonucleotide
  source 1..32: mol_type = other DNA
cgacagacgcctgatctagatcttgtgtccgt

SEQ ID NO: 1741 - DNA, 25 bp, synthetic construct
  misc_feature 1..25: note = synthetic oligonucleotide
  source 1..25: mol_type = other DNA
gatcacggacacaagatctagatca

SEQ ID NO: 1742 - DNA, 32 bp, synthetic construct
  misc_feature 1..32: note = synthetic oligonucleotide
  source 1..32: mol_type = other DNA
cgacagacgcctgatctagatcctcattcgct

SEQ ID NO: 1743 - DNA, 25 bp, synthetic construct
  misc_feature 1..25: note = synthetic oligonucleotide
  source 1..25: mol_type = other DNA
gatcagcgaatgaggatctagatca

SEQ ID NO: 1744 - DNA, 32 bp, synthetic construct
  misc_feature 1..32: note = synthetic oligonucleotide
  source 1..32: mol_type = other DNA
cgacagacgcctgatctagatagtgttcggct

SEQ ID NO: 1745 - DNA, 25 bp, synthetic construct
  misc_feature 1..25: note = synthetic oligonucleotide
  source 1..25: mol_type = other DNA
gatcagccgaacactatctagatca

SEQ ID NO: 1746 - DNA, 32 bp, synthetic construct
  misc_feature 1..32: note = synthetic oligonucleotide
  source 1..32: mol_type = other DNA
cgacagacgcctgatctagaggttgttgtcct

SEQ ID NO: 1747 - DNA, 25 bp, synthetic construct
  misc_feature 1..25: note = synthetic oligonucleotide
  source 1..25: mol_type = other DNA
gatcaggacaacaacctctagatca

SEQ ID NO: 1748 - DNA, 32 bp, synthetic construct
  misc_feature 1..32: note = synthetic oligonucleotide
  source 1..32: mol_type = other DNA
cgacagacgcctgatctagaggaacttgacgt

SEQ ID NO: 1749 - DNA, 25 bp, synthetic construct
  misc_feature 1..25: note = synthetic oligonucleotide
  source 1..25: mol_type = other DNA
gatcacgtcaagttcctctagatca

SEQ ID NO: 1750 - DNA, 32 bp, synthetic construct
  misc_feature 1..32: note = synthetic oligonucleotide
  source 1..32: mol_type = other DNA
cgacagacgcctgatctagactacaatccgct

SEQ ID NO: 1751 - DNA, 25 bp, synthetic construct
  misc_feature 1..25: note = synthetic oligonucleotide
  source 1..25: mol_type = other DNA
gatcagcggattgtagtctagatca

SEQ ID NO: 1752 - DNA, 32 bp, synthetic construct
  misc_feature 1..32: note = synthetic oligonucleotide
  source 1..32: mol_type = other DNA
cgacagacgcctgatctagaccacttacacgt

SEQ ID NO: 1753 - DNA, 25 bp, synthetic construct
  misc_feature 1..25: note = synthetic oligonucleotide
  source 1..25: mol_type = other DNA
gatcacgtgtaagtggtctagatca

SEQ ID NO: 1754 - DNA, 32 bp, synthetic construct
  misc_feature 1..32: note = synthetic oligonucleotide
  source 1..32: mol_type = other DNA
cgacagacgcctgatctagacagccaccttat

SEQ ID NO: 1755 - DNA, 25 bp, synthetic construct
  misc_feature 1..25: note = synthetic oligonucleotide
  source 1..25: mol_type = other DNA
gatcataaggtggctgtctagatca

SEQ ID NO: 1756 - DNA, 32 bp, synthetic construct
  misc_feature 1..32: note = synthetic oligonucleotide
  source 1..32: mol_type = other DNA
cgacagacgcctgatctagacaacctctggat

SEQ ID NO: 1757 - DNA, 25 bp, synthetic construct
  misc_feature 1..25: note = synthetic oligonucleotide
  source 1..25: mol_type = other DNA
gatcatccagaggttgtctagatca

SEQ ID NO: 1758 - DNA, 32 bp, synthetic construct
  misc_feature 1..32: note = synthetic oligonucleotide
  source 1..32: mol_type = other DNA
cgacagacgcctgatctagacaaaccttccgt

SEQ ID NO: 1759 - DNA, 25 bp, synthetic construct
  misc_feature 1..25: note = synthetic oligonucleotide
  source 1..25: mol_type = other DNA
gatcacggaaggtttgtctagatca

SEQ ID NO: 1760 - DNA, 32 bp, synthetic construct
  misc_feature 1..32: note = synthetic oligonucleotide
  source 1..32: mol_type = other DNA
cgacagacgcctgatctagaatcactacgcct

SEQ ID NO: 1761 - DNA, 25 bp, synthetic construct
  misc_feature 1..25: note = synthetic oligonucleotide
  source 1..25: mol_type = other DNA
gatcaggcgtagtgattctagatca

SEQ ID NO: 1762 - DNA, 32 bp, synthetic construct
  misc_feature 1..32: note = synthetic oligonucleotide
  source 1..32: mol_type = other DNA
cgacagacgcctgatctactttgtggagagct

SEQ ID NO: 1763 - DNA, 25 bp, synthetic construct
  misc_feature 1..25: note = synthetic oligonucleotide
  source 1..25: mol_type = other DNA
gatcagctctccacaaagtagatca

SEQ ID NO: 1764 - DNA, 32 bp, synthetic construct
  misc_feature 1..32: note = synthetic oligonucleotide
  source 1..32: mol_type = other DNA
cgacagacgcctgatctacttggtaagagcgt

SEQ ID NO: 1765 - DNA, 25 bp, synthetic construct
  misc_feature 1..25: note = synthetic oligonucleotide
  source 1..25: mol_type = other DNA
gatcacgctcttaccaagtagatca

SEQ ID NO: 1766 - DNA, 32 bp, synthetic construct
  misc_feature 1..32: note = synthetic oligonucleotide
  source 1..32: mol_type = other DNA
cgacagacgcctgatctacttgagcagaacct

SEQ ID NO: 1767 - DNA, 25 bp, synthetic construct
  misc_feature 1..25: note = synthetic oligonucleotide
  source 1..25: mol_type = other DNA
gatcaggttctgctcaagtagatca

SEQ ID NO: 1768 - DNA, 32 bp, synthetic construct
  misc_feature 1..32: note = synthetic oligonucleotide
  source 1..32: mol_type = other DNA
cgacagacgcctgatctacttcgttgagtcct

SEQ ID NO: 1769 - DNA, 25 bp, synthetic construct
  misc_feature 1..25: note = synthetic oligonucleotide
  source 1..25: mol_type = other DNA
gatcaggactcaacgaagtagatca

SEQ ID NO: 1770 - DNA, 32 bp, synthetic construct
  misc_feature 1..32: note = synthetic oligonucleotide
  source 1..32: mol_type = other DNA
cgacagacgcctgatctacttcgagttgtcct

SEQ ID NO: 1771 - DNA, 25 bp, synthetic construct
  misc_feature 1..25: note = synthetic oligonucleotide
  source 1..25: mol_type = other DNA
gatcaggacaactcgaagtagatca

SEQ ID NO: 1772 - DNA, 32 bp, synthetic construct
  misc_feature 1..32: note = synthetic oligonucleotide
  source 1..32: mol_type = other DNA
cgacagacgcctgatctacttagaagcgacct

SEQ ID NO: 1773 - DNA, 25 bp, synthetic construct
  misc_feature 1..25: note = synthetic oligonucleotide
  source 1..25: mol_type = other DNA
gatcaggtcgcttctaagtagatca

SEQ ID NO: 1774 - DNA, 32 bp, synthetic construct
  misc_feature 1..32: note = synthetic oligonucleotide
  source 1..32: mol_type = other DNA
cgacagacgcctgatctacttagaacaggcgt

SEQ ID NO: 1775 - DNA, 25 bp, synthetic construct
  misc_feature 1..25: note = synthetic oligonucleotide
  source 1..25: mol_type = other DNA
gatcacgcctgttctaagtagatca

SEQ ID NO: 1776 - DNA, 32 bp, synthetic construct
  misc_feature 1..32: note = synthetic oligonucleotide
  source 1..32: mol_type = other DNA
cgacagacgcctgatctacttaagcgaggact

SEQ ID NO: 1777 - DNA, 25 bp, synthetic construct
  misc_feature 1..25: note = synthetic oligonucleotide
  source 1..25: mol_type = other DNA
gatcagtcctcgcttaagtagatca

SEQ ID NO: 1778 - DNA, 32 bp, synthetic construct
  misc_feature 1..32: note = synthetic oligonucleotide
  source 1..32: mol_type = other DNA
cgacagacgcctgatctactggtgtttggact

SEQ ID NO: 1779 - DNA, 25 bp, synthetic construct
  misc_feature 1..25: note = synthetic oligonucleotide
  source 1..25: mol_type = other DNA
gatcagtccaaacaccagtagatca

SEQ ID NO: 1780 - DNA, 32 bp, synthetic construct
  misc_feature 1..32: note = synthetic oligonucleotide
  source 1..32: mol_type = other DNA
cgacagacgcctgatctactgatgagttggct

SEQ ID NO: 1781 - DNA, 25 bp, synthetic construct
  misc_feature 1..25: note = synthetic oligonucleotide
  source 1..25: mol_type = other DNA
gatcagccaactcatcagtagatca

SEQ ID NO: 1782 - DNA, 32 bp, synthetic construct
  misc_feature 1..32: note = synthetic oligonucleotide
  source 1..32: mol_type = other DNA
cgacagacgcctgatctactcggaacattggt

SEQ ID NO: 1783 - DNA, 25 bp, synthetic construct
  misc_feature 1..25: note = synthetic oligonucleotide
  source 1..25: mol_type = other DNA
gatcaccaatgttccgagtagatca

SEQ ID NO: 1784 - DNA, 32 bp, synthetic construct
  misc_feature 1..32: note = synthetic oligonucleotide
  source 1..32: mol_type = other DNA
cgacagacgcctgatctactcaatagaccgct

SEQ ID NO: 1785 - DNA, 25 bp, synthetic construct
  misc_feature 1..25: note = synthetic oligonucleotide
  source 1..25: mol_type = other DNA
gatcagcggtctattgagtagatca

SEQ ID NO: 1786 - DNA, 32 bp, synthetic construct
  misc_feature 1..32: note = synthetic oligonucleotide
  source 1..32: mol_type = other DNA
cgacagacgcctgatctactacactgaaccgt

SEQ ID NO: 1787 - DNA, 18 bp, synthetic construct
  misc_feature 1..18: note = synthetic oligonucleotide
  source 1..18: mol_type = other DNA
gatcacggttcagtgtag

SEQ ID NO: 1788 - DNA, 32 bp, synthetic construct
  misc_feature 1..32: note = synthetic oligonucleotide
  source 1..32: mol_type = other DNA
cgacagacgcctgatctactacaagtccacgt

SEQ ID NO: 1789 - DNA, 18 bp, synthetic construct
  misc_feature 1..18: note = synthetic oligonucleotide
  source 1..18: mol_type = other DNA
gatcacgtggacttgtag

SEQ ID NO: 1790 - DNA, 32 bp, synthetic construct
  misc_feature 1..32: note = synthetic oligonucleotide
  source 1..32: mol_type = other DNA
cgacagacgcctgatctactaagagttgccgt

SEQ ID NO: 1791 - DNA, 25 bp, synthetic construct
  misc_feature 1..25: note = synthetic oligonucleotide
  source 1..25: mol_type = other DNA
gatcacggcaactcttagtagatca

SEQ ID NO: 1792 - DNA, 32 bp, synthetic construct
  misc_feature 1..32: note = synthetic oligonucleotide
  source 1..32: mol_type = other DNA
cgacagacgcctgatctacgttctccttagct

SEQ ID NO: 1793 - DNA, 25 bp, synthetic construct
  misc_feature 1..25: note = synthetic oligonucleotide
  source 1..25: mol_type = other DNA
gatcagctaaggagaacgtagatca

SEQ ID NO: 1794 - DNA, 32 bp, synthetic construct
  misc_feature 1..32: note = synthetic oligonucleotide
  source 1..32: mol_type = other DNA
cgacagacgcctgatctacgtgtaggtgttct

SEQ ID NO: 1795 - DNA, 25 bp, synthetic construct
  misc_feature 1..25: note = synthetic oligonucleotide
  source 1..25: mol_type = other DNA
gatcagaacacctacacgtagatca

SEQ ID NO: 1796 - DNA, 32 bp, synthetic construct
  misc_feature 1..32: note = synthetic oligonucleotide
  source 1..32: mol_type = other DNA
cgacagacgcctgatctacgtagttggtctgt

SEQ ID NO: 1797 - DNA, 25 bp, synthetic construct
  misc_feature 1..25: note = synthetic oligonucleotide
  source 1..25: mol_type = other DNA
gatcacagaccaactacgtagatca

SEQ ID NO: 1798 - DNA, 32 bp, synthetic construct
  misc_feature 1..32: note = synthetic oligonucleotide
  source 1..32: mol_type = other DNA
cgacagacgcctgatctacgctaactccttgt

SEQ ID NO: 1799 - DNA, 25 bp, synthetic construct
  misc_feature 1..25: note = synthetic oligonucleotide
  source 1..25: mol_type = other DNA
gatcacaaggagttagcgtagatca

SEQ ID NO: 1800 - DNA, 32 bp, synthetic construct
  misc_feature 1..32: note = synthetic oligonucleotide
  source 1..32: mol_type = other DNA
cgacagacgcctgatctacgccaaatcctagt

SEQ ID NO: 1801 - DNA, 25 bp, synthetic construct
  misc_feature 1..25: note = synthetic oligonucleotide
  source 1..25: mol_type = other DNA
gatcactaggatttggcgtagatca

SEQ ID NO: 1802 - DNA, 32 bp, synthetic construct
  misc_feature 1..32: note = synthetic oligonucleotide
  source 1..32: mol_type = other DNA
cgacagacgcctgatctacgattctgtgaggt

SEQ ID NO: 1803 - DNA, 25 bp, synthetic construct
  misc_feature 1..25: note = synthetic oligonucleotide
  source 1..25: mol_type = other DNA
gatcacctcacagaatcgtagatca

SEQ ID NO: 1804 - DNA, 32 bp, synthetic construct
  misc_feature 1..32: note = synthetic oligonucleotide
  source 1..32: mol_type = other DNA
cgacagacgcctgatctacgattccaccaagt

SEQ ID NO: 1805 - DNA, 25 bp, synthetic construct
  misc_feature 1..25: note = synthetic oligonucleotide
  source 1..25: mol_type = other DNA
gatcacttggtggaatcgtagatca

SEQ ID NO: 1806 - DNA, 32 bp, synthetic construct
  misc_feature 1..32: note = synthetic oligonucleotide
  source 1..32: mol_type = other DNA
cgacagacgcctgatctacgatattgcctcct

SEQ ID NO: 1807 - DNA, 25 bp, synthetic construct
  misc_feature 1..25: note = synthetic oligonucleotide
  source 1..25: mol_type = other DNA
gatcaggaggcaatatcgtagatca

SEQ ID NO: 1808 - DNA, 32 bp, synthetic construct
  misc_feature 1..32: note = synthetic oligonucleotide
  source 1..32: mol_type = other DNA
cgacagacgcctgatctacgatagaggttgct

SEQ ID NO: 1809 - DNA, 25 bp, synthetic construct
  misc_feature 1..25: note = synthetic oligonucleotide
  source 1..25: mol_type = other DNA
gatcagcaacctctatcgtagatca

SEQ ID NO: 1810 - DNA, 32 bp, synthetic construct
  misc_feature 1..32: note = synthetic oligonucleotide
  source 1..32: mol_type = other DNA
cgacagacgcctgatctacgaatgactggagt

SEQ ID NO: 1811 - DNA, 25 bp, synthetic construct
  misc_feature 1..25: note = synthetic oligonucleotide
  source 1..25: mol_type = other DNA
gatcactccagtcattcgtagatca

SEQ ID NO: 1812 - DNA, 32 bp, synthetic construct
  misc_feature 1..32: note = synthetic oligonucleotide
  source 1..32: mol_type = other DNA
cgacagacgcctgatctacgaaatcctagcct

SEQ ID NO: 1813 - DNA, 25 bp, synthetic construct
  misc_feature 1..25: note = synthetic oligonucleotide
  source 1..25: mol_type = other DNA
gatcaggctaggatttcgtagatca

SEQ ID NO: 1814 - DNA, 32 bp, synthetic construct
  misc_feature 1..32: note = synthetic oligonucleotide
  source 1..32: mol_type = other DNA
cgacagacgcctgatctaccttagtagccgat

SEQ ID NO: 1815 - DNA, 25 bp, synthetic construct
  misc_feature 1..25: note = synthetic oligonucleotide
  source 1..25: mol_type = other DNA
gatcatcggctactaaggtagatca

SEQ ID NO: 1816 - DNA, 32 bp, synthetic construct
  misc_feature 1..32: note = synthetic oligonucleotide
  source 1..32: mol_type = other DNA
cgacagacgcctgatctacctggtgtttacgt

SEQ ID NO: 1817 - DNA, 25 bp, synthetic construct
  misc_feature 1..25: note = synthetic oligonucleotide
  source 1..25: mol_type = other DNA
gatcacgtaaacaccaggtagatca

SEQ ID NO: 1818 - DNA, 32 bp, synthetic construct
  misc_feature 1..32: note = synthetic oligonucleotide
  source 1..32: mol_type = other DNA
cgacagacgcctgatctacctggcctctttat

SEQ ID NO: 1819 - DNA, 25 bp, synthetic construct
  misc_feature 1..25: note = synthetic oligonucleotide
  source 1..25: mol_type = other DNA
gatcataaagaggccaggtagatca

SEQ ID NO: 1820 - DNA, 32 bp, synthetic construct
  misc_feature 1..32: note = synthetic oligonucleotide
  source 1..32: mol_type = other DNA
cgacagacgcctgatctacctggaaaggactt

SEQ ID NO: 1821 - DNA, 25 bp, synthetic construct
  misc_feature 1..25: note = synthetic oligonucleotide
  source 1..25: mol_type = other DNA
gatcaagtcctttccaggtagatca

SEQ ID NO: 1822 - DNA, 32 bp, synthetic construct
  misc_feature 1..32: note = synthetic oligonucleotide
  source 1..32: mol_type = other DNA
cgacagacgcctgatctacctgaggtgtttgt

SEQ ID NO: 1823 - DNA, 25 bp, synthetic construct
  misc_feature 1..25: note = synthetic oligonucleotide
  source 1..25: mol_type = other DNA
gatcacaaacacctcaggtagatca

SEQ ID NO: 1824 - DNA, 32 bp, synthetic construct
  misc_feature 1..32: note = synthetic oligonucleotide
  source 1..32: mol_type = other DNA
cgacagacgcctgatctacctattctgtgcgt

SEQ ID NO: 1825 - DNA, 25 bp, synthetic construct
  misc_feature 1..25: note = synthetic oligonucleotide
  source 1..25: mol_type = other DNA
gatcacgcacagaataggtagatca

SEQ ID NO: 1826 - DNA, 32 bp, synthetic construct
  misc_feature 1..32: note = synthetic oligonucleotide
  source 1..32: mol_type = other DNA
cgacagacgcctgatctaccgttgttagtcct

SEQ ID NO: 1827 - DNA, 25 bp, synthetic construct
  misc_feature 1..25: note = synthetic oligonucleotide
  source 1..25: mol_type = other DNA
gatcaggactaacaacggtagatca

SEQ ID NO: 1828 - DNA, 32 bp, synthetic construct
  misc_feature 1..32: note = synthetic oligonucleotide
  source 1..32: mol_type = other DNA
cgacagacgcctgatctaccgtgtatggttgt

SEQ ID NO: 1829 - DNA, 25 bp, synthetic construct
  misc_feature 1..25: note = synthetic oligonucleotide
  source 1..25: mol_type = other DNA
gatcacaaccatacacggtagatca

SEQ ID NO: 1830 - DNA, 32 bp, synthetic construct
  misc_feature 1..32: note = synthetic oligonucleotide
  source 1..32: mol_type = other DNA
cgacagacgcctgatctaccggtgtaagagat

SEQ ID NO: 1831 - DNA, 25 bp, synthetic construct
  misc_feature 1..25: note = synthetic oligonucleotide
  source 1..25: mol_type = other DNA
gatcatctcttacaccggtagatca

SEQ ID NO: 1832 - DNA, 32 bp, synthetic construct
  misc_feature 1..32: note = synthetic oligonucleotide
  source 1..32: mol_type = other DNA
cgacagacgcctgatctaccggaaatggatgt

SEQ ID NO: 1833 - DNA, 25 bp, synthetic construct
  misc_feature 1..25: note = synthetic oligonucleotide
  source 1..25: mol_type = other DNA
gatcacatccatttccggtagatca

SEQ ID NO: 1834 - DNA, 32 bp, synthetic construct
  misc_feature 1..32: note = synthetic oligonucleotide
  source 1..32: mol_type = other DNA
cgacagacgcctgatctaccgattgaggagat

SEQ ID NO: 1835 - DNA, 25 bp, synthetic construct
  misc_feature 1..25: note = synthetic oligonucleotide
  source 1..25: mol_type = other DNA
gatcatctcctcaatcggtagatca

SEQ ID NO: 1836 - DNA, 32 bp, synthetic construct
  misc_feature 1..32: note = synthetic oligonucleotide
  source 1..32: mol_type = other DNA
cgacagacgcctgatctaccatctgtcttcgt

SEQ ID NO: 1837 - DNA, 25 bp, synthetic construct
  misc_feature 1..25: note = synthetic oligonucleotide
  source 1..25: mol_type = other DNA
gatcacgaagacagatggtagatca

SEQ ID NO: 1838 - DNA, 32 bp, synthetic construct
  misc_feature 1..32: note = synthetic oligonucleotide
  source 1..32: mol_type = other DNA
cgacagacgcctgatctaccagttgacttcct

SEQ ID NO: 1839 - DNA, 25 bp, synthetic construct
  misc_feature 1..25: note = synthetic oligonucleotide
  source 1..25: mol_type = other DNA
gatcaggaagtcaactggtagatca

SEQ ID NO: 1840 - DNA, 32 bp, synthetic construct
  misc_feature 1..32: note = synthetic oligonucleotide
  source 1..32: mol_type = other DNA
cgacagacgcctgatctaccactttcggatct

SEQ ID NO: 1841 - DNA, 25 bp, synthetic construct
  misc_feature 1..25: note = synthetic oligonucleotide
  source 1..25: mol_type = other DNA
gatcagatccgaaagtggtagatca

SEQ ID NO: 1842 - DNA, 32 bp, synthetic construct
  misc_feature 1..32: note = synthetic oligonucleotide
  source 1..32: mol_type = other DNA
cgacagacgcctgatctaccaatagcggatct

SEQ ID NO: 1843 - DNA, 25 bp, synthetic construct
  misc_feature 1..25: note = synthetic oligonucleotide
  source 1..25: mol_type = other DNA
gatcagatccgctattggtagatca

SEQ ID NO: 1844 - DNA, 32 bp, synthetic construct
  misc_feature 1..32: note = synthetic oligonucleotide
  source 1..32: mol_type = other DNA
cgacagacgcctgatctaccaaggtatgcagt

SEQ ID NO: 1845 - DNA, 25 bp, synthetic construct
  misc_feature 1..25: note = synthetic oligonucleotide
  source 1..25: mol_type = other DNA
gatcactgcataccttggtagatca

SEQ ID NO: 1846 - DNA, 32 bp, synthetic construct
  misc_feature 1..32: note = synthetic oligonucleotide
  source 1..32: mol_type = other DNA
cgacagacgcctgatctaccaaatagctccgt

SEQ ID NO: 1847 - DNA, 25 bp, synthetic construct
  misc_feature 1..25: note = synthetic oligonucleotide
  source 1..25: mol_type = other DNA
gatcacggagctatttggtagatca

SEQ ID NO: 1848 - DNA, 32 bp, synthetic construct
  misc_feature 1..32: note = synthetic oligonucleotide
  source 1..32: mol_type = other DNA
cgacagacgcctgatctacatttgacctccgt

SEQ ID NO: 1849 - DNA, 25 bp, synthetic construct
  misc_feature 1..25: note = synthetic oligonucleotide
  source 1..25: mol_type = other DNA
gatcacggaggtcaaatgtagatca

SEQ ID NO: 1850 - DNA, 32 bp, synthetic construct
  misc_feature 1..32: note = synthetic oligonucleotide
  source 1..32: mol_type = other DNA
cgacagacgcctgatctacatgttcctctcgt

SEQ ID NO: 1851 - DNA, 25 bp, synthetic construct
  misc_feature 1..25: note = synthetic oligonucleotide
  source 1..25: mol_type = other DNA
gatcacgagaggaacatgtagatca

SEQ ID NO: 1852 - DNA, 32 bp, synthetic construct
  misc_feature 1..32: note = synthetic oligonucleotide
  source 1..32: mol_type = other DNA
cgacagacgcctgatctacatgtgtggagtct

SEQ ID NO: 1853 - DNA, 25 bp, synthetic construct
  misc_feature 1..25: note = synthetic oligonucleotide
  source 1..25: mol_type = other DNA
gatcagactccacacatgtagatca

SEQ ID NO: 1854 - DNA, 32 bp, synthetic construct
  misc_feature 1..32: note = synthetic oligonucleotide
  source 1..32: mol_type = other DNA
cgacagacgcctgatctacatacctagccgat

SEQ ID NO: 1855 - DNA, 25 bp, synthetic construct
  misc_feature 1..25: note = synthetic oligonucleotide
  source 1..25: mol_type = other DNA
gatcatcggctaggtatgtagatca

SEQ ID NO: 1856 - DNA, 32 bp, synthetic construct
  misc_feature 1..32: note = synthetic oligonucleotide
  source 1..32: mol_type = other DNA
cgacagacgcctgatctacagttcgttgaggt

SEQ ID NO: 1857 - DNA, 25 bp, synthetic construct
  misc_feature 1..25: note = synthetic oligonucleotide
  source 1..25: mol_type = other DNA
gatcacctcaacgaactgtagatca

SEQ ID NO: 1858 - DNA, 32 bp, synthetic construct
  misc_feature 1..32: note = synthetic oligonucleotide
  source 1..32: mol_type = other DNA
cgacagacgcctgatctacaggaattgaggct

SEQ ID NO: 1859 - DNA, 25 bp, synthetic construct
  misc_feature 1..25: note = synthetic oligonucleotide
  source 1..25: mol_type = other DNA
gatcagcctcaattcctgtagatca

SEQ ID NO: 1860 - DNA, 32 bp, synthetic construct
  misc_feature 1..32: note = synthetic oligonucleotide
  source 1..32: mol_type = other DNA
cgacagacgcctgatctacagaagttgagcct

SEQ ID NO: 1861 - DNA, 25 bp, synthetic construct
  misc_feature 1..25: note = synthetic oligonucleotide
  source 1..25: mol_type = other DNA
gatcaggctcaacttctgtagatca

SEQ ID NO: 1862 - DNA, 32 bp, synthetic construct
  misc_feature 1..32: note = synthetic oligonucleotide
  source 1..32: mol_type = other DNA
cgacagacgcctgatctacacctaatgaccgt

SEQ ID NO: 1863 - DNA, 25 bp, synthetic construct
  misc_feature 1..25: note = synthetic oligonucleotide
  source 1..25: mol_type = other DNA
gatcacggtcattaggtgtagatca

SEQ ID NO: 1864 - DNA, 32 bp, synthetic construct
  misc_feature 1..32: note = synthetic oligonucleotide
  source 1..32: mol_type = other DNA
cgacagacgcctgatctacaataggtgctcgt

SEQ ID NO: 1865 - DNA, 25 bp, synthetic construct
  misc_feature 1..25: note = synthetic oligonucleotide
  source 1..25: mol_type = other DNA
gatcacgagcacctattgtagatca

SEQ ID NO: 1866 - DNA, 32 bp, synthetic construct
  misc_feature 1..32: note = synthetic oligonucleotide
  source 1..32: mol_type = other DNA
cgacagacgcctgatctacaacgataggctct

SEQ ID NO: 1867 - DNA, 25 bp, synthetic construct
  misc_feature 1..25: note = synthetic oligonucleotide
  source 1..25: mol_type = other DNA
gatcagagcctatcgttgtagatca

SEQ ID NO: 1868 - DNA, 32 bp, synthetic construct
  misc_feature 1..32: note = synthetic oligonucleotide
  source 1..32: mol_type = other DNA
cgacagacgcctgatctacaacaggtcttcct

SEQ ID NO: 1869 - DNA, 25 bp, synthetic construct
  misc_feature 1..25: note = synthetic oligonucleotide
  source 1..25: mol_type = other DNA
gatcaggaagacctgttgtagatca

SEQ ID NO: 1870 - DNA, 32 bp, synthetic construct
  misc_feature 1..32: note = synthetic oligonucleotide
  source 1..32: mol_type = other DNA
cgacagacgcctgatctaattggtctcgtggt

SEQ ID NO: 1871 - DNA, 25 bp, synthetic construct
  misc_feature 1..25: note = synthetic oligonucleotide
  source 1..25: mol_type = other DNA
gatcaccacgagaccaattagatca

SEQ ID NO: 1872 - DNA, 32 bp, synthetic construct
  misc_feature 1..32: note = synthetic oligonucleotide
  source 1..32: mol_type = other DNA
cgacagacgcctgatctaattctgctctcggt

SEQ ID NO: 1873 - DNA, 25 bp, synthetic construct
  misc_feature 1..25: note = synthetic oligonucleotide
  source 1..25: mol_type = other DNA
gatcaccgagagcagaattagatca

SEQ ID NO: 1874 - DNA, 32 bp, synthetic construct
  misc_feature 1..32: note = synthetic oligonucleotide
  source 1..32: mol_type = other DNA
cgacagacgcctgatctaattcgaccaccagt

SEQ ID NO: 1875 - DNA, 25 bp, synthetic construct
  misc_feature 1..25: note = synthetic oligonucleotide
  source 1..25: mol_type = other DNA
gatcactggtggtcgaattagatca

SEQ ID NO: 1876 - DNA, 32 bp, synthetic construct
  misc_feature 1..32: note = synthetic oligonucleotide
  source 1..32: mol_type = other DNA
cgacagacgcctgatctaattcacctctggct

SEQ ID NO: 1877 - DNA, 25 bp, synthetic construct
  misc_feature 1..25: note = synthetic oligonucleotide
  source 1..25: mol_type = other DNA
gatcagccagaggtgaattagatca

SEQ ID NO: 1878 - DNA, 32 bp, synthetic construct
  misc_feature 1..32: note = synthetic oligonucleotide
  source 1..32: mol_type = other DNA
cgacagacgcctgatctaattagctggacggt

SEQ ID NO: 1879 - DNA, 25 bp, synthetic construct
  misc_feature 1..25: note = synthetic oligonucleotide
  source 1..25: mol_type = other DNA
gatcaccgtccagctaattagatca

SEQ ID NO: 1880 - DNA, 32 bp, synthetic construct
  misc_feature 1..32: note = synthetic oligonucleotide
  source 1..32: mol_type = other DNA
cgacagacgcctgatctaatgtcctggttggt

SEQ ID NO: 1881 - DNA, 25 bp, synthetic construct
  misc_feature 1..25: note = synthetic oligonucleotide
  source 1..25: mol_type = other DNA
gatcaccaaccaggacattagatca

SEQ ID NO: 1882 - DNA, 32 bp, synthetic construct
  misc_feature 1..32: note = synthetic oligonucleotide
  source 1..32: mol_type = other DNA
cgacagacgcctgatctaatggagtcaaggct

SEQ ID NO: 1883 - DNA, 25 bp, synthetic construct
  misc_feature 1..25: note = synthetic oligonucleotide
  source 1..25: mol_type = other DNA
gatcagccttgactccattagatca

SEQ ID NO: 1884 - DNA, 32 bp, synthetic construct
  misc_feature 1..32: note = synthetic oligonucleotide
  source 1..32: mol_type = other DNA
cgacagacgcctgatctaatgatacggcaggt

SEQ ID NO: 1885 - DNA, 25 bp, synthetic construct
  misc_feature 1..25: note = synthetic oligonucleotide
  source 1..25: mol_type = other DNA
gatcacctgccgtatcattagatca

SEQ ID NO: 1886 - DNA, 32 bp, synthetic construct
  misc_feature 1..32: note = synthetic oligonucleotide
  source 1..32: mol_type = other DNA
cgacagacgcctgatctaatctatccacggct

SEQ ID NO: 1887 - DNA, 25 bp, synthetic construct
  misc_feature 1..25: note = synthetic oligonucleotide
  source 1..25: mol_type = other DNA
gatcagccgtggatagattagatca

SEQ ID NO: 1888 - DNA, 32 bp, synthetic construct
  misc_feature 1..32: note = synthetic oligonucleotide
  source 1..32: mol_type = other DNA
cgacagacgcctgatctaatctaccttgccgt

SEQ ID NO: 1889 - DNA, 25 bp, synthetic construct
  misc_feature 1..25: note = synthetic oligonucleotide
  source 1..25: mol_type = other DNA
gatcacggcaaggtagattagatca

SEQ ID NO: 1890 - DNA, 32 bp, synthetic construct
  misc_feature 1..32: note = synthetic oligonucleotide
  source 1..32: mol_type = other DNA
cgacagacgcctgatctaatcgaaggtaggct

SEQ ID NO: 1891 - DNA, 25 bp, synthetic construct
  misc_feature 1..25: note = synthetic oligonucleotide
  source 1..25: mol_type = other DNA
gatcagcctaccttcgattagatca

SEQ ID NO: 1892 - DNA, 32 bp, synthetic construct
  misc_feature 1..32: note = synthetic oligonucleotide
  source 1..32: mol_type = other DNA
cgacagacgcctgatctaatccttgcctctgt

SEQ ID NO: 1893 - DNA, 25 bp, synthetic construct
  misc_feature 1..25: note = synthetic oligonucleotide
  source 1..25: mol_type = other DNA
gatcacagaggcaaggattagatca

SEQ ID NO: 1894 - DNA, 32 bp, synthetic construct
  misc_feature 1..32: note = synthetic oligonucleotide
  source 1..32: mol_type = other DNA
cgacagacgcctgatctaatccgtcttgtcct

SEQ ID NO: 1895 - DNA, 25 bp, synthetic construct
  misc_feature 1..25: note = synthetic oligonucleotide
  source 1..25: mol_type = other DNA
gatcaggacaagacggattagatca

SEQ ID NO: 1896 - DNA, 32 bp, synthetic construct
  misc_feature 1..32: note = synthetic oligonucleotide
  source 1..32: mol_type = other DNA
cgacagacgcctgatctaatcactgtctccgt

SEQ ID NO: 1897 - DNA, 25 bp, synthetic construct
  misc_feature 1..25: note = synthetic oligonucleotide
  source 1..25: mol_type = other DNA
gatcacggagacagtgattagatca

SEQ ID NO: 1898 - DNA, 32 bp, synthetic construct
  misc_feature 1..32: note = synthetic oligonucleotide
  source 1..32: mol_type = other DNA
cgacagacgcctgatctaatattcggaggcgt

SEQ ID NO: 1899 - DNA, 25 bp, synthetic construct
  misc_feature 1..25: note = synthetic oligonucleotide
  source 1..25: mol_type = other DNA
gatcacgcctccgaatattagatca

SEQ ID NO: 1900 - DNA, 32 bp, synthetic construct
  misc_feature 1..32: note = synthetic oligonucleotide
  source 1..32: mol_type = other DNA
cgacagacgcctgatctaatattcgcctccgt

SEQ ID NO: 1901 - DNA, 25 bp, synthetic construct
  misc_feature 1..25: note = synthetic oligonucleotide
  source 1..25: mol_type = other DNA
gatcacggaggcgaatattagatca

SEQ ID NO: 1902 - DNA, 32 bp, synthetic construct
  misc_feature 1..32: note = synthetic oligonucleotide
  source 1..32: mol_type = other DNA
cgacagacgcctgatctaatatgccgaggtgt

SEQ ID NO: 1903 - DNA, 25 bp, synthetic construct
  misc_feature 1..25: note = synthetic oligonucleotide
  source 1..25: mol_type = other DNA
gatcacacctcggcatattagatca

SEQ ID NO: 1904 - DNA, 32 bp, synthetic construct
  misc_feature 1..32: note = synthetic oligonucleotide
  source 1..32: mol_type = other DNA
cgacagacgcctgatctaatagttggctcggt

SEQ ID NO: 1905 - DNA, 25 bp, synthetic construct
  misc_feature 1..25: note = synthetic oligonucleotide
  source 1..25: mol_type = other DNA
gatcaccgagccaactattagatca

SEQ ID NO: 1906 - DNA, 32 bp, synthetic construct
  misc_feature 1..32: note = synthetic oligonucleotide
  source 1..32: mol_type = other DNA
cgacagacgcctgatctaataccacctgacgt

SEQ ID NO: 1907 - DNA, 25 bp, synthetic construct
  misc_feature 1..25: note = synthetic oligonucleotide
  source 1..25: mol_type = other DNA
gatcacgtcaggtggtattagatca

SEQ ID NO: 1908 - DNA, 32 bp, synthetic construct
  misc_feature 1..32: note = synthetic oligonucleotide
  source 1..32: mol_type = other DNA
cgacagacgcctgatctaagttggtgtcctgt

SEQ ID NO: 1909 - DNA, 25 bp, synthetic construct
  misc_feature 1..25: note = synthetic oligonucleotide
  source 1..25: mol_type = other DNA
gatcacaggacaccaacttagatca

SEQ ID NO: 1910 - DNA, 32 bp, synthetic construct
  misc_feature 1..32: note = synthetic oligonucleotide
  source 1..32: mol_type = other DNA
cgacagacgcctgatctaagttgctcctgtct

SEQ ID NO: 1911 - DNA, 25 bp, synthetic construct
  misc_feature 1..25: note = synthetic oligonucleotide
  source 1..25: mol_type = other DNA
gatcagacaggagcaacttagatca

SEQ ID NO: 1912 - DNA, 32 bp, synthetic construct
  misc_feature 1..32: note = synthetic oligonucleotide
  source 1..32: mol_type = other DNA
cgacagacgcctgatctaagttcggttaggct

SEQ ID NO: 1913 - DNA, 25 bp, synthetic construct
  misc_feature 1..25: note = synthetic oligonucleotide
  source 1..25: mol_type = other DNA
gatcagcctaaccgaacttagatca

SEQ ID NO: 1914 - DNA, 32 bp, synthetic construct
  misc_feature 1..32: note = synthetic oligonucleotide
  source 1..32: mol_type = other DNA
cgacagacgcctgatctaagttcctcggttgt

SEQ ID NO: 1915 - DNA, 25 bp, synthetic construct
  misc_feature 1..25: note = synthetic oligonucleotide
  source 1..25: mol_type = other DNA
gatcacaaccgaggaacttagatca

SEQ ID NO: 1916 - DNA, 32 bp, synthetic construct
  misc_feature 1..32: note = synthetic oligonucleotide
  source 1..32: mol_type = other DNA
cgacagacgcctgatctaagtgtagaagccgt

SEQ ID NO: 1917 - DNA, 25 bp, synthetic construct
  misc_feature 1..25: note = synthetic oligonucleotide
  source 1..25: mol_type = other DNA
gatcacggcttctacacttagatca

SEQ ID NO: 1918 - DNA, 32 bp, synthetic construct
  misc_feature 1..32: note = synthetic oligonucleotide
  source 1..32: mol_type = other DNA
cgacagacgcctgatctaagtacatcaggcgt

SEQ ID NO: 1919 - DNA, 25 bp, synthetic construct
  misc_feature 1..25: note = synthetic oligonucleotide
  source 1..25: mol_type = other DNA
gatcacgcctgatgtacttagatca

SEQ ID NO: 1920 - DNA, 32 bp, synthetic construct
  misc_feature 1..32: note = synthetic oligonucleotide
  source 1..32: mol_type = other DNA
cgacagacgcctgatctaaggttgcttctggt

SEQ ID NO: 1921 - DNA, 25 bp, synthetic construct
  misc_feature 1..25: note = synthetic oligonucleotide
  source 1..25: mol_type = other DNA
gatcaccagaagcaaccttagatca

SEQ ID NO: 1922 - DNA, 32 bp, synthetic construct
  misc_feature 1..32: note = synthetic oligonucleotide
  source 1..32: mol_type = other DNA
cgacagacgcctgatctaaggttctctcacgt

SEQ ID NO: 1923 - DNA, 25 bp, synthetic construct
  misc_feature 1..25: note = synthetic oligonucleotide
  source 1..25: mol_type = other DNA
gatcacgtgagagaaccttagatca

SEQ ID NO: 1924 - DNA, 32 bp, synthetic construct
  misc_feature 1..32: note = synthetic oligonucleotide
  source 1..32: mol_type = other DNA
cgacagacgcctgatctaaggcctttaccact

SEQ ID NO: 1925 - DNA, 25 bp, synthetic construct
  misc_feature 1..25: note = synthetic oligonucleotide
  source 1..25: mol_type = other DNA
gatcagtggtaaaggccttagatca

SEQ ID NO: 1926 - DNA, 32 bp, synthetic construct
  misc_feature 1..32: note = synthetic oligonucleotide
  source 1..32: mol_type = other DNA
cgacagacgcctgatctaaggatctttcggct

SEQ ID NO: 1927 - DNA, 25 bp, synthetic construct
  misc_feature 1..25: note = synthetic oligonucleotide
  source 1..25: mol_type = other DNA
gatcagccgaaagatccttagatca

SEQ ID NO: 1928 - DNA, 32 bp, synthetic construct
  misc_feature 1..32: note = synthetic oligonucleotide
  source 1..32: mol_type = other DNA
cgacagacgcctgatctaaggataactcggct

SEQ ID NO: 1929 - DNA, 25 bp, synthetic construct
  misc_feature 1..25: note = synthetic oligonucleotide
  source 1..25: mol_type = other DNA
gatcagccgagttatccttagatca

SEQ ID NO: 1930 - DNA, 32 bp, synthetic construct
  misc_feature 1..32: note = synthetic oligonucleotide
  source 1..32: mol_type = other DNA
cgacagacgcctgatctaaggaatactggcgt

SEQ ID NO: 1931 - DNA, 25 bp, synthetic construct
  misc_feature 1..25: note = synthetic oligonucleotide
  source 1..25: mol_type = other DNA
gatcacgccagtattccttagatca

SEQ ID NO: 1932 - DNA, 32 bp, synthetic construct
  misc_feature 1..32: note = synthetic oligonucleotide
  source 1..32: mol_type = other DNA
cgacagacgcctgatctaactttccggtctct

SEQ ID NO: 1933 - DNA, 25 bp, synthetic construct
  misc_feature 1..25: note = synthetic oligonucleotide
  source 1..25: mol_type = other DNA
gatcagagaccggaaagttagatca

SEQ ID NO: 1934 - DNA, 32 bp, synthetic construct
  misc_feature 1..32: note = synthetic oligonucleotide
  source 1..32: mol_type = other DNA
cgacagacgcctgatctaacttagagtggcgt

SEQ ID NO: 1935 - DNA, 25 bp, synthetic construct
  misc_feature 1..25: note = synthetic oligonucleotide
  source 1..25: mol_type = other DNA
gatcacgccactctaagttagatca

SEQ ID NO: 1936 - DNA, 32 bp, synthetic construct
  misc_feature 1..32: note = synthetic oligonucleotide
  source 1..32: mol_type = other DNA
cgacagacgcctgatctaacgtcttctcaggt

SEQ ID NO: 1937 - DNA, 25 bp, synthetic construct
  misc_feature 1..25: note = synthetic oligonucleotide
  source 1..25: mol_type = other DNA
gatcacctgagaagacgttagatca

SEQ ID NO: 1938 - DNA, 32 bp, synthetic construct
  misc_feature 1..32: note = synthetic oligonucleotide
  source 1..32: mol_type = other DNA
cgacagacgcctgatctaacgtatggagagct

SEQ ID NO: 1939 - DNA, 25 bp, synthetic construct
  misc_feature 1..25: note = synthetic oligonucleotide
  source 1..25: mol_type = other DNA
gatcagctctccatacgttagatca

SEQ ID NO: 1940 - DNA, 32 bp, synthetic construct
  misc_feature 1..32: note = synthetic oligonucleotide
  source 1..32: mol_type = other DNA
cgacagacgcctgatctaacgaactcacctgt

SEQ ID NO: 1941 - DNA, 25 bp, synthetic construct
  misc_feature 1..25: note = synthetic oligonucleotide
  source 1..25: mol_type = other DNA
gatcacaggtgagttcgttagatca

SEQ ID NO: 1942 - DNA, 32 bp, synthetic construct
  misc_feature 1..32: note = synthetic oligonucleotide
  source 1..32: mol_type = other DNA
cgacagacgcctgatctaaccggttcttctct

SEQ ID NO: 1943 - DNA, 25 bp, synthetic construct
  misc_feature 1..25: note = synthetic oligonucleotide
  source 1..25: mol_type = other DNA
gatcagagaagaaccggttagatca

SEQ ID NO: 1944 - DNA, 32 bp, synthetic construct
  misc_feature 1..32: note = synthetic oligonucleotide
  source 1..32: mol_type = other DNA
cgacagacgcctgatctaaattggctcctcct

SEQ ID NO: 1945 - DNA, 25 bp, synthetic construct
  misc_feature 1..25: note = synthetic oligonucleotide
  source 1..25: mol_type = other DNA
gatcaggaggagccaatttagatca

SEQ ID NO: 1946 - DNA, 32 bp, synthetic construct
  misc_feature 1..32: note = synthetic oligonucleotide
  source 1..32: mol_type = other DNA
cgacagacgcctgatctaaattcggagaggct

SEQ ID NO: 1947 - DNA, 25 bp, synthetic construct
  misc_feature 1..25: note = synthetic oligonucleotide
  source 1..25: mol_type = other DNA
gatcagcctctccgaatttagatca

SEQ ID NO: 1948 - DNA, 32 bp, synthetic construct
  misc_feature 1..32: note = synthetic oligonucleotide
  source 1..32: mol_type = other DNA
cgacagacgcctgatctaaatgacctccacgt

SEQ ID NO: 1949 - DNA, 25 bp, synthetic construct
  misc_feature 1..25: note = synthetic oligonucleotide
  source 1..25: mol_type = other DNA
gatcacgtggaggtcatttagatca

SEQ ID NO: 1950 - DNA, 32 bp, synthetic construct
  misc_feature 1..32: note = synthetic oligonucleotide
  source 1..32: mol_type = other DNA
cgacagacgcctgatctaaatcaggctccact

SEQ ID NO: 1951 - DNA, 25 bp, synthetic construct
  misc_feature 1..25: note = synthetic oligonucleotide
  source 1..25: mol_type = other DNA
gatcagtggagcctgatttagatca

SEQ ID NO: 1952 - DNA, 32 bp, synthetic construct
  misc_feature 1..32: note = synthetic oligonucleotide
  source 1..32: mol_type = other DNA
cgacagacgcctgatctaaagttccagctcct

SEQ ID NO: 1953 - DNA, 25 bp, synthetic construct
  misc_feature 1..25: note = synthetic oligonucleotide
  source 1..25: mol_type = other DNA
gatcaggagctggaactttagatca

SEQ ID NO: 1954 - DNA, 32 bp, synthetic construct
  misc_feature 1..32: note = synthetic oligonucleotide
  source 1..32: mol_type = other DNA
cgacagacgcctgatctaaagtaacctcgcct

SEQ ID NO: 1955 - DNA, 25 bp, synthetic construct
  misc_feature 1..25: note = synthetic oligonucleotide
  source 1..25: mol_type = other DNA
gatcaggcgaggttactttagatca

SEQ ID NO: 1956 - DNA, 32 bp, synthetic construct
  misc_feature 1..32: note = synthetic oligonucleotide
  source 1..32: mol_type = other DNA
cgacagacgcctgatctaaaggtgtctggtct

SEQ ID NO: 1957 - DNA, 25 bp, synthetic construct
  misc_feature 1..25: note = synthetic oligonucleotide
  source 1..25: mol_type = other DNA
gatcagaccagacacctttagatca

SEQ ID NO: 1958 - DNA, 32 bp, synthetic construct
  misc_feature 1..32: note = synthetic oligonucleotide
  source 1..32: mol_type = other DNA
cgacagacgcctgatctaaagctgttcctcct

SEQ ID NO: 1959 - DNA, 25 bp, synthetic construct
  misc_feature 1..25: note = synthetic oligonucleotide
  source 1..25: mol_type = other DNA
gatcaggaggaacagctttagatca

SEQ ID NO: 1960 - DNA, 32 bp, synthetic construct
  misc_feature 1..32: note = synthetic oligonucleotide
  source 1..32: mol_type = other DNA
cgacagacgcctgatctaaactggacacctct

SEQ ID NO: 1961 - DNA, 25 bp, synthetic construct
  misc_feature 1..25: note = synthetic oligonucleotide
  source 1..25: mol_type = other DNA
gatcagaggtgtccagtttagatca

SEQ ID NO: 1962 - DNA, 32 bp, synthetic construct
  misc_feature 1..32: note = synthetic oligonucleotide
  source 1..32: mol_type = other DNA
cgacagacgcctgatctaaacctatccgagct

SEQ ID NO: 1963 - DNA, 25 bp, synthetic construct
  misc_feature 1..25: note = synthetic oligonucleotide
  source 1..25: mol_type = other DNA
gatcagctcggataggtttagatca

SEQ ID NO: 1964 - DNA, 37 bp, synthetic construct
  misc_feature 1..37: note = synthetic oligonucleotide
  source 1..37: mol_type = other DNA
tcgatggtttggcgcgccggtagtttgaaccatccat

SEQ ID NO: 1965 - DNA, 38 bp, synthetic construct
  misc_feature 1..38: note = synthetic oligonucleotide
  source 1..38: mol_type = other DNA
gccatttacaaactaggtattaatcgatcctgcatgcc

SEQ ID NO: 1966 - DNA, 18 bp, synthetic construct
  misc_feature 1..18: note = synthetic oligonucleotide
  source 1..18: mol_type = other DNA
tcgatggtttggcgcgcc

SEQ ID NO: 1967 - DNA, 18 bp, synthetic construct
  misc_feature 1..18: note = synthetic oligonucleotide
  source 1..18: mol_type = other DNA
aatcgatcctgcatgcca

SEQ ID NO: 1968 - DNA, 15 bp, synthetic construct
  misc_feature 1..15: note = synthetic oligonucleotide
  source 1..15: mol_type = other DNA
gctagggctaatatc

SEQ ID NO: 1969 - DNA, 27 bp, synthetic construct
  misc_feature 1..27: note = synthetic oligonucleotide
  source 1..27: mol_type = other DNA
attatgagcacgacagacgcctgatct

SEQ ID NO: 1970 - DNA, 33 bp, synthetic construct
  misc_feature 1..33: note = synthetic oligonucleotide
  source 1..33: mol_type = other DNA
gatcagatcaggcgtctgtcgtcgtgctcataa

SEQ ID NO: 1971 - DNA, 21 bp, synthetic construct
  misc_feature 1..21: note = synthetic oligonucleotide
  source 1..21: mol_type = other DNA
gccatttacaaactaggtatt

SEQ ID NO: 1972 - DNA, 42 bp, synthetic construct
  misc_feature 1..42: note = synthetic oligonucleotide
  source 1..42: mol_type = other DNA
attatgagcacgacagacgcctgatctnnnnnnnnnnnnnnt

SEQ ID NO: 1973 - DNA, 46 bp, synthetic construct
  misc_feature 1..46: note = synthetic oligonucleotide
  source 1..46: mol_type = other DNA
gatcannnnnnnnnnnnnnagatcaggcgtctgtcgtgctcagtaa

SEQ ID NO: 1974 - DNA, 32 bp, synthetic construct
  misc_feature 1..32: note = synthetic oligonucleotide
  source 1..32: mol_type = other DNA
cgacagacgcctgatctnnnnnnnnnnnnnnt

SEQ ID NO: 1975 - DNA, 25 bp, synthetic construct
  misc_feature 1..25: note = synthetic oligonucleotide
  source 1..25: mol_type = other DNA
gatcannnnnnnnnnnnnnagatca

SEQ ID NO: 1976 - DNA, 103 bp, synthetic construct
  misc_feature 1..103: note = synthetic oligonucleotide
  source 1..103: mol_type = other DNA
tgatctnnnnnnnnnnnnnntgatccnnnnnnnnnnnnnnnnnnnnnnnnnnnnnnnnnnnnnnnnnnnnnnnnnnnggatcannnnnnnnnnnnnnagatca

SEQ ID NO: 1977 - DNA, 25 bp, synthetic construct
  misc_feature 1..25: note = synthetic oligonucleotide
  source 1..25: mol_type = other DNA
aaggccttcacgacagacgcctgat

SEQ ID NO: 1978 - DNA, 32 bp, synthetic construct; identical to SEQ ID NO: 1974
  misc_feature 1..32: note = synthetic oligonucleotide
  source 1..32: mol_type = other DNA

SEQ ID NO: 1979 - DNA, 24 bp, synthetic construct
  misc_feature 1..24: note = synthetic oligonucleotide
  source 1..24: mol_type = other DNA
ctagannnnnnnnnnnnnnactag

What is claimed is:

1. A method of preparing a sample, comprising:
obtaining a plurality of first molecules and a plurality of second molecules,
wherein the obtaining step comprises generating the plurality of first molecules and the plurality of second molecules from occurrences of a first target molecule and occurrences of a second target molecule, respectively, and labels from a set of diverse labels,
wherein the set of diverse labels comprises labels with m different label sequences,
wherein one or more of the plurality of first molecules and the plurality second molecules comprises an occurrence of the first target molecule or the complementary thereof and an occurrence of the second target molecule or the complementary thereof, respectively, and a label sequence or the complementary thereof from the set of diverse labels,
wherein more than 90% of the plurality of first molecules and the plurality of second molecules have a label sequence that is different from the label sequences on the other of the plurality of first molecules and the other of the plurality of second molecules, respectively,
wherein n1 and n2 are a number of occurrences of the first target molecule and a number of occurrences the second target molecule, respectively, and
wherein the ratio of the greater of n1 and n2 to m is smaller than 0.2.

2. The method of claim 1, wherein the plurality of first molecules or the plurality of second molecules comprises labels with k different label sequences, wherein n is $n_1$ or $n_2$, wherein m and n are related by E(k), wherein $$E(k) = m\left[1 - \left(1 - \frac{1}{m}\right)^n\right],$$

and wherein E(k) denotes the mean of k.

3. The method of claim 1, wherein the plurality of first molecules or the plurality of second molecules comprises labels with k different label sequences, wherein n is $n_1$ or $n_2$, wherein m and n are related by Var(k), wherein $$\mathrm{Var}(k) = m\left[1 - \left(1 - \frac{1}{m}\right)^n\right]\left(1 - \frac{1}{m}\right)^n + m(m-1)\left[\left(1 - \frac{2}{m}\right)^n - \left(1 - \frac{1}{m}\right)^{2n}\right],$$

and wherein Var(k) denotes the variance of k.

4. The method of claim 1, wherein the plurality of first molecules or the plurality of second molecules comprises labels with t different label sequences exactly x times,
wherein n is $n_1$ or $n_2$,
wherein m and n are related by E(t),
wherein $$E(t) = \frac{m, nt}{x^i(n-x)t}\left(\frac{1}{m}\right)^x\left(1-\frac{1}{m}\right)^{n-x},$$

and wherein E(t) denotes the mean of t.

5. The method of claim 1, wherein the plurality of first molecules or the plurality of second molecules comprises the labels exactly x times,
wherein n is $n_1$ or $n_2$,
wherein in and n are related by Var(t),
wherein $$\text{Var}(t) = A(1-A) + (m-1)m \cdot \binom{n}{2x} \cdot \left(\frac{2}{m}\right)^{2x}\left(1-\frac{2}{m}\right)^{n-2x}\binom{2x}{x}\left(\frac{1}{2}\right)^{2x},$$

wherein Var(t) denotes the variance of k, and wherein $$A = m \cdot \binom{m}{x} \cdot \left(\frac{1}{m}\right)^x\left(1-\frac{1}{m}\right)^{n-x}.$$

6. The method of claim 1, wherein the ratio of the greater of $n_1$ and $n_2$ to m is smaller than 0.02.

7. The method of claim 1, comprising detecting the plurality of first molecules and the plurality of second molecules by detecting the label sequences present on the plurality of first molecules and the plurality of second molecules or products thereof, wherein the detected first molecules and the detected second molecules indicate the number of occurrences of the first target molecule and the number of occurrence of the second target molecule, respectively.

8. The method of claim 7, wherein detecting the label sequences present on plurality of first molecules comprises obtaining sequences of the plurality of first molecules.

9. The method of claim 8, wherein obtaining the sequences present on the plurality of first molecules comprises sequencing the plurality of first molecules or products thereof.

10. The method of claim 9, further comprising mapping sequencing reads that are obtained from sequencing the plurality of first molecules, or products thereof, to a reference sequence.

11. The method of claim 9, further comprising aligning sequencing reads obtained from sequencing the plurality of first molecules, or products thereof.

12. The method of claim 9, further comprising detecting a mismatch in the label sequence or the copy of the first target molecule in sequencing reads obtained from sequencing the plurality of first molecules, or products thereof.

13. The method of claim 9, wherein sequencing the plurality of first molecules comprises sequencing a portion of the label sequence or a portion of the copy of the first target molecule, or a product thereof.

14. The method of claim 9, wherein the label sequences present on the plurality of first molecules indicates the number of occurrences of the first target molecule.

15. The method of claim 14, comprising scoring a label sequence in sequencing reads obtained from sequencing the plurality of first molecules or products thereof.

16. The method of claim 7, wherein the detecting step comprises detecting the label sequences present on amplification products of the plurality of first molecules and the plurality of second molecules.

17. The method of claim 16, wherein the amplification products comprise polymerase chain reaction (PCR) amplification products.

18. The method of claim 16, further comprising performing one or more amplification steps to generate the amplification products.

19. The method of claim 1, wherein the copy of the label sequence of a first molecule of the plurality of first molecules is 3' to the copy of the first target molecule of the first molecule.

20. The method of claim 1, wherein the copy of the label sequence of a first molecule of the plurality of first molecules is 5' to the copy of the first target molecule of the first molecule.

21. The method of claim 1, wherein the generating step comprises reverse transcription of an occurrence of the first target molecule and/or the second target molecule.

22. The method of claim 1, wherein the generating step is performed using a reverse transcriptase, a polymerase, or a combination thereof.

23. The method of claim 1, wherein the copy of the first molecule in a first molecule of the plurality of first molecules comprises a reverse complement of the first molecule, or a portion thereof, and wherein the copy of the label sequence in the first molecule of the plurality of first molecules comprises a reverse complement of a label sequence of a label of the set of diverse labels.

24. The method of claim 1, wherein the copy of the first molecule in a first molecule of the plurality of first molecules comprises a reverse complement of the first molecule, or a portion thereof, and wherein the copy of the label sequence in the first molecule of the plurality of first molecules comprises a label of the set of diverse labels, or a portion thereof.

25. The method of claim 1, wherein the first target molecule comprises an oligonucleotide.

26. The method of claim 25, wherein the oligonucleotide is ribonucleic acid (RNA) or deoxyribonucleic acid (DNA).

27. The method of claim 1, wherein the first target molecule comprises RNA, and wherein the second target molecule comprises DNA.

28. The method of claim 1, wherein one or more of the first target molecule and the second target molecule comprise a RNA, DNA, antibody, or a combination thereof.

29. The method of claim 1, wherein the first target molecule is associated with an antibody.

30. A method of preparing a sample, comprising:
obtaining a plurality of first molecules and a plurality of second molecules,
wherein the plurality of first molecules and the plurality of second molecules are generated from occurrences of a first target molecule and occurrences of a second target molecule, respectively, and labels from a set of diverse labels,
wherein the set of diverse labels comprises labels with m different label sequences,
wherein one or more of the plurality of first molecules and the plurality second molecules comprises an occurrence of the first target molecule or the complementary thereof and an occurrence of the second target molecule or the complementary thereof, respectively, and a label sequence or the complementary thereof from the set of diverse labels, wherein more than 90% of the plurality of first molecules and the plurality of second molecules have a label sequence that is different from the label sequences on the other of the plurality of first molecules and the other of the plurality of second molecules, respectively, wherein:

the copy of the label sequence of a first molecule of the plurality of first molecules is 3' to the copy of the first target molecule of the first molecule; and/or the copy of the label sequence of a first molecule of the plurality of first molecules is 5' to the copy of the first target molecule of the first molecule, wherein n1 and n2 are a number of occurrences of the first target molecule and a number of occurrences the second target molecule, respectively, and wherein the ratio of the greater of n1 and n2 to m is smaller than 0.2.

* * * * *